United States Patent 8,765,408 (PROPHAGE ELEMENT-FREE BACTERIA) - sequence listing, part 2

SEQ ID NO: 1 - DNA, 4639675 bp, Escherichia coli (residues 1,546,560-3,093,118 of 4,639,675)
tctgcggtacgccaaaagccgacttcctgaaagtgtgtgaagtgctggcctccaccagcgcaccggatcgcacaaccaccttcctgtacgcgctgggctggacgcagcacactgtgggtgcgcagaacatccgtactatggcgatgatccagttgctgctcggtaacatgggtatggccggtggcggcgtgaacgcattgcgtggtcactccaacattcagggcttgactgacttaggcctgctctctaccagcctgccaggttatctgacgctgccgtcagaaaaacaggttgatttgcagtcgtatctggaagcgaacacgccgaaagcgacgctggctgatcaggtgaactactggagcaactatccgaagttcttcgttagcctgatgaaatctttctatggcgatgccgcgcagaaagagaacaactggggctatgactggctgccgaagtgggaccagacctacgacgtcatcaagtatttcaacatgatggatgaaggcaaagtcaccggttatttctgccagggctttaacccggttgcgtccttcccggacaaaaacaaagtggtgagctgcctgagcaagctgaagtacatggtggttatcgatccgctggtgactgaaacctctaccttctggcagaaccacggtgagtcgaacgatgtcgatccggcgtctattcagactgaagtattccgtctgccttcgacctgctttgctgaagaagatggttctatcgctaactccggtcgctggttgcagtggcactggaaaggtcaggacgcgccgggcgaagcgcgtaacgacggtgaaattctggcgggtatctaccatcatctgcgcgagctgtaccagtccgaaggtggtaaaggcgtagaaccgctgatgaagatgagctggaactacaagcagccgcacgaaccgcaatctgacgaagtggctaaagagaacaacggctacgcgctggaagatctctatgacgctaatggcgtgcttattgcgaagaaaggtcagttgctgagtagctttgcgcatctgcgtgatgacggtacaaccgcatcttcttgctggatctacaccggtagctggacagagcagggcaaccagatggctaaccgcgataactccgacccgtccggtctggggaatacgctgggatgggcctgggcgtggccgctcaaccgtcgcgtgctgtacaaccgtgcttcggcggatatcaacggtaaaccgtgggatccgaaacggatgctgatccagtggaacggcagcaagtggacgggtaacgatattcctgacttcggcaatgccgcaccgggtacgccaaccgggccgtttatcatgcagccggaagggatgggacgcctgtttgccatcaacaaaatggcggaaggtccgttcccggaacactacgagccgattgaaacgccgctgggcactaacccgctgcatccgaacgtggtgtctaacccggttgttcgtctgtatgaacaagacgcgctgcggatgggtaaaaaagagcagttcccgtatgtgggtacgacctatcgtctgaccgagcacttccacacctggaccaagcacgcattgctcaacgcaattgctcagccggaacagtttgtggaaatcagcgaaacgctggcggcggcgaaaggcattaataatggcgatcgtgtcactgtctccagcaagcgtggctttatccgcgcggtggctgtggtaacgcgtcgtctgaaaccgctgaatgtaaatggtcagcaggttgaaacggtgggtattccaatccactggggctttgagggtgtcgcgcgtaaaggttatatcgctaacactctgacgccgaatgtcggtgatgcaaactcgcaaacgccggaatataaagcgttcttagtcaacatcgagaaggcgtaagggggcgaacagatggctatggaaacgcaggacattatcaaaaggtccgcaactaactccatcacgccgccttctcaggtgcgtgattacaaagcagaagtcgcaaaacttatcgacgtttccacctgtatcggctgtaaagcctgtcaggtggcgtgttcggagtggaacgacatccgtgatgaagtggggcactgcgtcggggtttacgataaccccgccgatctgagcgccaagtcctggacggtgatgcgctttagcgaaaccgaacagaacggcaagctggagtggctgatccgtaaagacggctgtatgcactgtgaagatcccggctgcctgaaggcgtgcccgtctgctggtgcaatcattcagtacgctaacgggattgtcgatttccagtcggaaaactgcatcggctgtggttactgcattgccgggtgtccgtttaatattccgcgcctcaacaaagaggataaccgggtatataaatgcacgctctgcgtcgatcgcgtcagcgtcggccaggaaccggcttgtgtgaaaacctgtccgaccggggctatccacttcggcaccaagaaggagatgctggagctggcggaacagcgcgtggcgaaactgaaagcgcgtggttacgaacatgctggcgtctacaacccggaaggggtcggtggtacgcacgttatgtacgtgctgcatcacgccgatcagccggagctgtatcacggtctgccgaaagatccgaagatcgacacctcggtaagcctgtggaaaggcgcgttgaaaccgctggcagcggctggctttattgccacttttgccgggttgattttccactacatcggtattggcccgaataaggaagtggacgatgacgaggaggatcatcatgagtaagtcgaaaatgattgtgcgcaccaaatttattgatcgcgcctgtcactggaccgtggtgatttgcttcttcctggtggcgctgtccgggatttcgttcttcttcccgacgctgcaatggctgacgcaaaccttcggtacgccgcagatgggacgcattttgcacccgttcttcggcattgcgattttcgtcgcactgatgtttatgtttgtgcgttttgtgcatcacaacatcccggataagaaagatattccgtggctgttgaacattgtcgaagtattgaaaggcaatgagcataaagtggcggatgtcggtaagtacaacgccgggcaaaagatgatgttctggtcgatcatgagcatgattttcgtgctgctggtgaccggggtgattatctggcgtccgtactttgcgcagtacttcccgatgcaggttgttcgctacagcctgctgatccacgcggctgcgggtatcatcctgatccacgccatcctgatccatatgtatatggcattttgggtgaaaggatcgattaaagggatgatcgaagggaaggtaagtcgtcgctgggcgaagaaacaccatccgcgctggtatcgtgaaatcgagaaggcagaagcgaaaaaagagagtgaagaagggatataatctcttttgaactttaagctgaaaatggcgctgtaaaaggcgccattttcatattgtagacaacgtaggctttgttcatgccggatgcggcgtgaacgccttatccggcatgaaaacccttcaaatccaatagattgcagtgaacgtgtaggcctgataagcgtagcgcatcaggcaatgttgcgtttgtcatcagtttcaaatggcgctgtaaaaggcgtcattttcatattgtagacaacgtaggctttgttcatgccggatgcggcgtgaacgccttatccggcatgaaaacccttcaaatccaatagattgcagtgaacgtgtaggcctgataagcgtagcgcatcaggcaatgttgcgtttgtcatcagttctaaatggcgctttataaagtgccatttttttattgcgtaaccagacggcgtaatcgcgacacatccactgttttttctgcctctgccagactccaggcgttttgcagattcagccacatttgcggcgaactgccgatcaccacggaaagtttaatcgccatttctggcgtcaaagctgcttttcctgtcagcaatcggcttgccgttgagggagcaatttccattgctctggcaaactcgcgcaggctgacattaagttcgtccagtgattcctgaataatgtcccccgggcggggatgattggccattttcattagtgtctttactctcagtagcgttccttcactgggaacactatcattattgttccttcctacgcaacaataatccatttagccatttcatgttggagagtgtgcgatgctgcgacccgaacatggcagtcgcagcaaaggcctcttagtgacggaaatcaatcaccatgcggccacggattttgccttcttccatctcagtaaagatggtgttgatgtccgctaacggacgcagggcgactttcggcaccactttaccttcggcggcaaactggaaggcttcagttaaatcctggcgcgtgccgaccagcgaaccgaccacttcaataccatccagcacaagacgtgggatatccaggctcatagactccggcggtagaccgacagccacaacacgaccgcctgcacggacagcatcaactgccgagttaaacgcagctttagctaccgctgttaccaccgcagcgtgagcgccaccagttttctcctgcacaattttggcggcgtcttcggtgtgtgagttaatcgctaaatctgcgcccatttcggttgccagttttaactgctcatcattgacatcaatggcgatcactttggcgttaaagacattcttcgcgtattgcagggcgaggttacccagaccgccaagaccgtagatagcaatccactgccctggacgaatttttgacagcttaacggctttgtaggtggtgactcccgcacaggtaatgctgctggccgccgccgagtccagaccatctggcacttttaccgcgtaatcggcgaccacgatgcactcttccgccatcccgccatcaacgctgtatccggcatttttaactgaacggcagagcgtttcgttaccactgttacagtattcgcaatgaccgcatccttcgtagaaccacgccacgctggcacgatcgcctggttttaatgaggtgacacctggacccacttctgccaccacaccgatgccttcatggcccagaattacgccggttttgtcaccaaaatcgccattcttaacatgaagatcggtatgacatacaccacaacactccattttcagcagggcttcgccatgtttcagtgagcgcagtgttttatacgtaacgtcaacatgatgatccttcgtaacaactgcagccttcatagttcctccttttcggatgatgttctgcatagcaggtgaggcaaatgagatttattcgccactacccagtatggatgagatctgaaaaagggagagggaaatagcccggtagccttcactaccgggcgcaggcttagatggaggtacggcggtagtcgcggtattcggcttgccagaaattatcgtcaatggcctgttgcagggcttcggcagaggttttcaccgccacgccttgctgctgcgccattttgccaaccgcaaacgcaattgcgcgggagactttctgaatatctttcagttccggcagtaccataccttcgccgttcagcaccaatggtgaatactgcgccagcgtttcacttgccgacatcagcatctcatcggtgatacgtgacgcgccggaagcaataacacccaggccgatgcccgggaaaataaaggcgttgttacactgggcgatagggtagattttatctttccataccactggattaaacgggctgcccgtggcgaccagcgcgttaccttcggtccaggcgataatgtcctgcggtgtggcttccacgcgtgacgtcgggttagacagcggcatcacgatcggacgcggacagtgtttatgcatctcacggatgatctcttccgtaaacagcccggtctgtcctgagacgccaatcagaatatctggttttacattgcgcaccacatccagcagtgacagcacatcgctgtcggtatcccagtcactgaggttttcgcgcttctgcaccagtttggtctggaaaggcagcaggttcggcatcttgtcagtcagcaagccaaagcgatcgaccataaagactttctgccgcgccgcttcctcgcttaatccttcgcgctgggtctgggagatgatcatttcggcaatgccgcatcccgctgaacctgcgccaaggaagacgatttttttctcgcttaactgaccacctgccgcgcggcttgctgcgatcagtgtgccgactgttaccgccgcagtgccctgaatgtcatcgttaaaagaacaaatttcattgcgatagcggttaagtaacggcatcgcatttttttgagcaaagtcttcaaactgcaacagcacgtctggccagcgttgtttcacagcctggataaattcatcaacgaattcatagtattcgtcgtcagtgatacgcggattacgccagcccatatacagcggatcgttaagcagctgttggttgttcgttccgacatccagcaccaccggaagggtatacgccgggctgatgccgccacaggcggtatagagcgacagtttaccgatcggaatgcccatcccgccgatgccctggtcaccaagccccagaatgcgttcaccgtcagtcaccacaatcactttaatattatggttcggcacgttttgcagaatatcgtccatattgtgccggttctggtaagagataaacacgccgcgtgaacggcggtagatctcagaaaaacgctcacaggctgcgccgacggttggggtataaataacaggcatcatctcatcaagatgattgtttaccagacggtagaagagggtttcgttagtgtcctggatgttacgcaggtagatgtgtttgtcgatttcggttttgaatccctgatactggatccatgctcgttccgcttgttcttcgatggtttcgaccacttccggcagtaaccccagcaggttgaagttacggcgttcttccatgctgaaggcactgcctttattcaacaacggaaattccagcagtacagggccagcgtaagggatataaagcgaacgctgtttttttgtttttggttccatgtcactcactcttttttgaatatccatccctggggggcttttatcgtctttgctttaccgccagggcgtcggcctcaagtataaagcagataaaaacaaaaacaccattgcgcaggcaatggtgtttaatcgtcattgaggactgatggttatgaattacttttcagcggggcgttttctgccggttgggttatttactacgctggatttgtcaccttcggtaactattttgcgctggttagaaattttatggtccagtccaagaatatgacgtgcctgacggttcgatttcattttaactcctcaatcctgtagctagttttaaggacaacatcgccgtagcgaagaaacacgtgctaaacccctaaattaggttgccgatcaagcatagcaccttaaagcgtagggtgctggccactgaccacataattgatcgtttgctggtagatatcactgaggatgtcgttatcagaagcttcaacccatttggtcagctccatgagaatgtcatcttcagtgacaacaccatgctgtgcccgaaggccttgctcaatggcattaaccagagcgggttctgctgttgaattttctgcctgataataagtaaacatagtgattctccgtgtctgtgtatttatggtgtctgctacggatcgcagatttataaagcacattcagcatggcaaatatttgccgcttcgttgttaagattagtcctggttgatgatttttatattttaacaccatgatattcatagggattgtgattggtatgatccgattaatattgatacaatatcttttgggttatatattcccggtaatctattgtgggaatttaatttaagtgcagaagtaatattttcgccggattttattcggaatatcctgcttatcctcgtgctgtttctcacgtagtctataatttcctttttaagcccacaggagagcaacaatgacaatccataagaaaggtcaggcacactgggaaggcgatatcaaacgcgggaagggaacagtatccaccgagagtggcgtgctgaaccaacagccgtatggatttaacacgcgttttgaaggcgaaaaaggaaccaaccctgaagaactgattggcgcagcgcatgccgcatgtttctcaatggcgctttcattaatgctgggggaagcgggattcacgccaacatcgattgataccaccgccgatgtgtcgctggataaagtggatgccggttttgcgattacgaaaatcgcactgaagagtgaagttgcggtgccgggtattgatgcctctacctttgacggcataatccagaaagcaaaagcaggatgcccggtctctcaggtactgaaagcggaaattacgctggattaccagttgaaatcgtaaagcattgccggatgacgcgtcaggcgcgtgaatgcctgatgcgttgttagcatctctacagcgcccgccagcaccggagctcacgtccgtcctcccttattgctaatgattgccggacttcacatccgtgggttgccagcgggcaacgttcgtagaaaaaacagccttgcggcaacgtgcggtttcccggcagatccgttttacgtaatgcccattcttcctccagcggtttatcaatggcggggagggaatccagcaataatcgggtgtatggatgtgcaggtgccgtcagcacctgctgcgcgtcgcccagttctacaatctgcccgagatacatcaccgccacccgatcgctcatatgacgtatcaccgagacattgtgtgaaatcagcacataggtcagcccgtgattttcctgtagcgttaccagtaaattgaggatctgcgcctgaacggagatatccagcgcagaggttggctcatcaagcacaatcacgtcaggctgcgaagagagtgctctggcaatggcgatacgttgccgctgcccgccggagaacgcatgaggcaggcggtcgagatactccggacgaatacccacctgcacagccaactcctctgccaacgctcgccgctgttgttcactactacgcttagctatccagagcggttctgtgatgatgcgccacaccggtaagcgcggattaagcgaagagagcgggtcctgaaacaccatctgcataatgcgttgtgagccagaacggatgtactgcccgtggctcggttgcagcatacccattaaaagctgtgcgagggtgcttttgccgcagcctgactcgccgacgatccctaaggtttcaccacggcggatctgtaaatcaataccattaatggcatgaacatgttccgtagttttaccaagccagtttttacgggccgggaaattgatatggacgtcgcgtaacgttaataacgtgtcagacacttataacctcctgctgcggataccaacaggcacagcgctggttgttgtcaccacacgctgtcagcgccgggacgttttcacactgtgcacctgccgcatagcaacgatcgcgaaaagcgcagccgtcaggcaaatgggtgaggtttggtaccgtccctggaatggcgggtaatagctggcgtggtactccatgttctggtgcgcattgcagcaaaccaatggtatacggatgccggggatgatggataacgtctgccgtcacgccgctttcaattacgcttccggcatacatcacgtaaacgctatcgcacagttgcgacaccacggccatatcatggctgatgaacagaaccgcagttccactggcgcgggctttatgtttaagcaaacgcagtacctgcaactgcaccgtgacgtccagcgccgtagtcggttcgtcggcaataatcaattgcggctcgcaggagaatgccagcgcaatcattacccgctggcgcataccacctgaaagctcaaacggatagcgcgacataacttccacggcatccgggatttgcatctcttccagcaggtcaatcgctttagctctggcttcccgacgacttattggttgatgatggcggatcacgtccatcatctgaagacctattcgacgtgtcggattgagggcggtcatcggttcctgaaagatcatcgccactcgtgcgccgcgccactgacgaagctgtttttcccgcgcgttaagaacatcttctcccagcagggaaatctgcccccgatgtacgcaataactgcccgtcggtagcagacgcataatcagcattgcggtgactgatttacctgagccggattctcccaccagaccgacaatttcaccgcggttaatctgcaaggacacattgttgagcgcgtgaacatcaccgttaaaaccggggaaactcaaatgcagttgttgaatgtccagaacgggttgggtcatgactgctttcctcctgctttcgggtcaagcagatcgcgaataccatcaccaaagagattaaacccgacggcggtaagcaaaatcgctgcccccggaaatgcgcaataccaccactgatcgagtacatagttgcgaccatttgctaccatcgcgccccattcagcactcggttgttgagcacccaggccaataaatcccaacgtggcggccattaaaatcgcgctaccgatatccagcgatgcctgcacgatcagcggcggtagggagttacgtaaaatatgccagttgatcagatgccaacgagacgcgccaaaggttttcgccgcctgaacataggtatactggcgtacaactaatgcttgcccccgcgccaggcgcacataaaagggaattcgcacaatagcaatagccagcatggcgttaaacaaactcggcccgagagcggcagccagtgccattgtcagtaccaacgaaggaatcgacagcataatgtccatgatgcgcatgatgatggcgtctgcgcgtccaccaagcacaccggatagacatccgagtagcgaaccaatcatacccgcaatggcaaccacgactaatccggcgagaattgattgctgactgccgaccagtacgcggctaaacagatcgcgtcccacttcatcggtgccaaaccagtgcgccgcagaaggcggcaaaaggcgggcggttaaatcaatggcgttgggatcatgcgtcgccagccacggtgaaaaaatcatcatcaatagcattaatacaatgatgactgcgctggtcacggtgagcggactgcctttcagcatccataccagttttgcaccgttaaatcgcgtttgtttttgtgggcgtacggcggacgtttcctcgcttagcatcattcaccacctccacgtccgatacgcggatcaatccacaaatagagcaaatccaccaccaggttgaccagcacataagcaaatgaaaccacgacggcaaagcccatcactgccgggaagtcgagcgcctgtattgatgttactacccatgcacccattccgggccaggcaaaaacggtttcggtgagcactgcgccatacaacaaatcgcccagcgccaaacccaatacggtaatcgatgggatcaacgcattgggtagcgcataacataaaacgatataccagccgggcaagccgctggcccgggcggtacgaatgtagtcttcactcaattgttccagcatcgctgagcggatctggcgagcgacaattcccaggtgaacgaacgccagcgttaatgccggtaagatgagatgttgcaacgcattgaagaagacttcaccgttgccttcaagcagcgcatcgagcagataaaagccggtaacgtgcgttggtggatccagccagtcatcaagccttccgccgccgggaagaatttgcagatgaccataaaacagcacaatgacgcccagcccaagccagaacgcaggtgtggagattccggtaatggccattattcgcaccagatgatccagccagcgatttcgccagactgcagagagtatgcccagcgggatgccaatcaggagtgccagcagcagggcaccaaaagccagctccagcgtcgccgggaaaaatatacgcaactcttccagcaccggacgcccggtacgaatggatgttcccaggtcaccatgaaacaggtcgctgacgtagcggtaaaactgtacatacagtggctggtccagtcccagttgctggcgaatattttccacgatagcatcgctggcgcggtcacccgccagtaaccgcgccggatcaccagggatcagatgcgagataataaacgtaatcacgcagacgcccgccaccacgagcaccagcccccagcagcgttggcgtaaaatactccagaaggtcacgttatttactcatggtattgatattgaagacctgttccagcatgggattgaacacaaagcctttcacctctttgttcatcgccagttggtagtttttctggaacaggtacacataagcagcgtcatcaatgacgattttctgtgcctgctggtagtcccgggtacgctgcgtctggtcggtggtcgcaagcgcattgcgcagtaacttatcgacctcactgttttcatagaacgagcggttacccggcagaccttttttgtctgactcaaaccagtaattcataaacatatacgggtcggcaaaatccggactccagttgccaatcgcaatgtcgtaatcacctttacccactctgtcgcgcatggtggcgttcgccagcttttccagcttcacaatgatgcccagcttgttgagactggattgtgtcgccagagcaataggctcccagttcggatcgttatcggagtagagaaacgtcaggctggtgggtttgctcgtcactttatcccattcggctttggctttcgtttcgtcatggttgtattgcattgccgtcgcatcgtagccccacatgccttccggaatcgggccgcgcatctgttttccgttaccactcagaatgccgttaaccatgccctgataatcggtagaccaggaaatggcccgacgcagatccgcctgattaagaggcgctttgctgttattcagatacagataggtaacgcgcagtgacggatactctgccacattgactttattttcctgcttcagggcgttgagttgatccaccggcagcgcatcggcaatgtcaatgtcgccacgggagagctgcaggcgacgggaggcactttcaccaataatttttaccgatacccgtttgaagttcggtttattgcctgggtaatgcggatttggcaccagaactaattgctgacctttttgccagcttttcagcataaatggtccggaaccggcggtattttgcgcgaggaagccgcgagcatcatccgctgcatgttcctttaagaccgccggattgataatggatgcaccgtcattcgccagcgtgtagaggaacggtgcgaatggttggctaagggtaaacttcaccgtatgttcgtcgggagcatcaatctttaaatctttgggaaatgcttctgctggcccctggccgatttttagtagccgctcaaaagaaagttttactgcttcggcagtgacaggtgtgccatcggcaaatttagcattatctttcagggtgaacgtccactctttttgatcgtcagacgctttccagctacttgccagatcgccttcaacgtcggttgagcctttatcaccgtccgttttgtactgaaccagccgctgataagacgggtaggtcactgtccagtcgttattatctattgttaccgccgggtcgagggtttgtggatcggcggccttaccaatcaccagcatatcttttggtacggcggcgtgcgcaaccgggaaatttgtggcaaggacgagcgcgagcaatgtgggacgaaacgatatcgatctcttcatgacagtttcctgattaactgacgtgctgtgtgccaggggatataaaacaagagaattgatcagcgagcagagggtaactcgctgcctggggtaattcgaagtgccaccattcgctggagataccgacaaaaccgccaccagtcattatcgcattcagcaacagccgattgcgctgagcggcgggcgggacggaagggtgataggcatgggagcgctcgtgcatttcatcgaaccctgcgcccatatcgaggatgttcccgtgctcatcacgaagcgtcaggtcgatcgccgtgccacggctgtgattagaaccgaccgtcacatcaacaacatattgcgggtctgggcaggcttgccacaacatcgcctgtgcttgttgtgggcgatacgcatcgtaaatcaccagttgtaaccctgacagctgggcgatgctgatacttttcgccagcgcggtaatcgcatccttgtgtaacagacaacgcgcttgctgataaatagctttacctgtgatgttatcagcgcaggcgtatttcaattcgatctccagatcagggaagattacggctaaatcaaccagttcggtggtatccgacataaacggttcctgtataagacaaaaattgctgcgctttccgcttatgcagatctcatgccatgccgggataagcgccagaatgctggcttaaagttatattttttaacttttgatcaacatttgtgcagcgtagtgcagttttggtgcaagaggggaagttaaggaaggaatctcccggaatcgtagctgaaatcacagtatttaagtgacagtgtcacgttaaatgaaaacccgcgagtgcgggcgagaggaatttgtcagattttcagcggtaacacgctgctcatccagcctggaatttcttcggcgggtagggggcgggaaaagaaatatccctgaataacgcgacagtggatcttgcgtagcatctcaaattgctctttggtttcgacgccttccgccacgacggttaaattgaggctttgcccaatgctggtaatggcttcaagtaaggcaaggatgcgtttttcggtcagacaacgatcgacaaaacttttgtcaattttgatttccgttaccggaagactgactaagcgggataatccggaaaagcccgtaccaaaatcatctaccgataagcccacgcccatatcacgcaggatctgaatgcgcttaaagatttcggtatcgtgttccatcatcatgctttccgtgatttctaccgtcagctggtggccgtcaataccccaggcgtgcattgcatcagacacctgattaggcagttgattactgcgaaagtgcagcgccgacaagttcacggataacgccgggatatgaatattctggctacgccattctgctaactgacggcaagcttccgcgatgacccagcgcccaatattttcgatttcaccaatctcttctgcgagaggaataaaccgtgaagggggcacatgaccatgcaggggatcgtgccagcgagcaagggcttcgatgccgtacagttcacccgtttctgcgaagatttgcggctggtaaaccagtttcagttggttattgctaatcgcttctttcagcgctgcgcctaaaaccaaacgctcttttaccatttcgttcatcgccgggctgaagaactgccagccgttaccgccattcttgcgaatataatccattgcattgtgagcagtggagagcaagtaatcgcggtttttacccaggtcgtagctgatgccaatactcaaggtaagcgggaagggtttatcgtcaatcattatcggcttgctgaccacattccgtagctcatcggcgatttgggtaatgttactgacgtcgttttcgaggctcacgaggacaaactgcgtaccttcgatacgacagagatactgatccggtttgagtttttcacgaaagcgattgaccacttccagcaatgcctgatcggcccacgcatagccaaggctatcaatcacatcctgaatatggtcaacaccgatgagatacaccacgggagagacggctttgtcgaccaggtcatcgaggtaattgtgcaggttattgcgatttggcagaccggtcatcggatcaaattggatgagttgttcaatatgctgacggcttttttcctgttccagcgccagcgcggccatatgctggctgatatctgccacgcgttcgataaaggcgctggtttctgctcctgacgaggttttaatttgcaggatccccgcaggcgcgccatcacgctgacgaatggtcgctgaccagctttgcgcattttgaatttctgcaccgtgggaagatgacgcccagtgtatcggcatcccgttgcgcagtgcgaacagcgaaacatgcgattcgttgagtacagattcgatgttacgacaaatgatttcccccatttcatgaaatggcgggctgctgcacatggcggcgagaatattgccttcaagctggcgaatctgccgttcttcggtgatatccgagaaagtcattaccaggttctgcagatgcgcgagcacgtcataaaccgggctgatagaggctttaatccagattttttcaccggtgcgcgtcaacagcagaaattcgtcctgatcgcgggcggttttccatagcaactgttgtaaacgaatgcggttatcggcagggaattcaggaatgttcaggagtgtatcgggctgcataccgctggcttcgctaatgcagtaaccaaacatttcggtaaatgcgcgattgcactgcacaatatggcgttccggatcgaggacaatcaccggtcggtcgagatggtcaacggcaataatcaattgtcgggtctgttctttttgcgccatttctacgctggcatcccgtaccagcgccaggtaataaactttcccctcggcgctcactttcgatagcgcaaaacgggtccagattttactgccgtcttttttctccagctgcagctcccgactcatcccctcaacacgcgctttaccgccttcacggttgtgacgaatgtattcaggatgcgcaggacgcaaatcccgcggaatcagcatatcaatgttattgccaatgacttcttcacgtttgtatccccagagcttctctgcggcggggttgaaaaacatcacttcatcattttcgttaattaacaccgcacccatcatattttgctcaagggcggggaaaaaaatgccatcggcggcattatccgcatcggttagcttcatgattacctctgcatcctggcgcatctaaagactggctttccagagttcaacacggtttctacctcgtcttttggcgatatacagagcttcatcggctatttgaatgaggcgctcatagtcaggatgaccattaaacatggcggcaccgatggaaagtgagagggcaatatcttcgccgtttgcggctttcagtttggttttctccacccgactgcgaatacgttctgcggtacgtaacgtttcgttttcagaagcttcagtcaaaacaatgataaattcatcgcccccgtagcggaaaacataatcactactgcggacgttgtcataaaaggcctgagagactttacgcagaatttcatcaccagtgttatggccccacgtatcgttgatctctttgaatttatcaacgtcaataatcagcactgacagcggtgtaccggtccggttggcatgggcaatttcgcgtttgaagatagtcggtaggaaacggcggttaagtaatttcgtcagtacatccataccgacttcgtggcgcgatacttcttcaaacaattcacgcagcaaggtaataatttgcgatacggtatttcttatctgtaataaaaatttcacccgcagacttctgttattcaaatttctggtgttacgcatggtttgattgaaaataccgtcgaaatcctgaatcagacgggagatatggcctacttcggcaataccactaaaataatgtcgacctttatggttaaaccacaggccaaaatcagcctggcttaaaggcaaactactgcctaaatcagaatccagcaggattttatagataatatctatttcccatgaaagtattgaggctatttgccgttctttttcttcttcggcgttttccagtaacgagaagatacgatagttttcatcttcctttgaggcactactgtcactaaaggtaaacgcgcgagtcatcacttccatcgcgatatcaatactgttaatcgagaaatggtagacctgaagtttttctgcggcggaataatccgaagagaagatcaccggatagaggatttttttcagcacccgaaaccccatctcgacaatttctaccggaattcctatgcgggcatgcacttccgcgacggtatgctggatttgtattagcctttcgacatcgtcaacctgggcagaaagcacgttaataatccagcgttccatcgcactcttcaactgccgctcaacttgttcattactcaagaattcttcggcatgcgggtcgatgcggacaattcgataaaactcgatactcagataatgagcatgcgcaacggcaatttccgcggctttagcacgaatgggcggatctgcctgttcgacaagtccggtccactcatctttcattcttttaaaatacatctccataattcacacccttataaggctgggaaatcagacggaatcaaaatgaaacgcaacgtgcgagatcgactaactgcaccatattctcctgaaatatgaagatatactgaaaagaaataagcgatttaggacagtttcaatctacgctactgttcttcagaagagtatagcccatcgtaattatttttcggtgacagcgaatatcgtatggtttttcatattcatacatttttattagggatttatggctgtttaactaagtgtggttaatttgacttaagtaagcatgattattagtgggatagtttaagagggtaacaagccggtgggtaaagcaccggcttgttacaaagtaagaatgggagtttaactgccccagcgactttgcagatagctgaccgcttgttgagtctgcggtttattcagatagtcctcacggaacaagatggtgccgctaatttcgggcacagcatcgttaagatcgagctgctttttcagttccggtacgccgccgttaatcatccagtctggctctatctttgaaggttcacccactttatagaaggcgataccgatatacaggcgggtcctggtcggtttaacgacatccgcccaccattttgccaacacgtcataacgcgcggcactccgtgagaacggccagtaaatttggggagcaatgtaatccagcaatccttgttccacccatcgacgggtgtcagcgtaggattcgtcataggctgccgcgcctcgggtatcggaaccgagcggatcgtgtgatcggttacgccacacgcctgccgggctaacaccaaattcgactcccggcttaatgcttttaatggtgtgcgatacctttgcaattaactgctgagtattgttgcgccgccagtctgcttttgacgcaaatgcgcctccgtatttacggtacgtttcgttatcatttagccgtgaacccggtgactccgtatagaaatagtcgtcaaactgcacgccatctacgggatagcgggaaaccacttctgcgactattgatgtgatccagtcctgaacctcagggatgcccgggtcgaggacaaagcgatcgccagacgttctgatccagtcgcggtgttgcacatagacgctcgccggttgttgagacagagtgctattcagttccctgatagtaccgggcttcgtattaaccgatacgcgataggggttaaaccaggcgtgtactttcatcccacgcttgtgggcttcgtcgagcataaattgcagcggatcgtaacccggattttcaccaatcttaccggtcataagatcggaccacggcaaaattttcgatggccacagggcggtaccgtccggcttgacctggaaaaagaccgtgtttatgccgagacgttgcagatgatccagtttgtcgatcatcgcctgttgttgtacacgggcccggctggtggggttactaatgttaaccgaggaaaccggtggccagtcgagccgagaaaccgtggccagccagatgccacgcatcggttgtgacgattgttgcgtcgtggctggtggctttgaacctgctggtggtgtcaccatggactctggaggcgtgcttttacaactacacagtaaaagtgccagtgcaactagtatcgctggtcttctaatcgttaatttcttgtttcgggagcagatatccatatgtgctggtttccggtaaacagatgtgcgctcattctcgtacttatccccgttaagtcaatacgacagcaagcacgaaaaagggagcgatgaattatcgctcccttgtcttataaccattcagacatggttagtgtttcttgtcattcatcacaatatagtgtggtgaacgtgcacgcgggtgcaggaagaagtgaccttttggtgcgttctgactgttgattggctccagagtgacgccggtatttgctttgcctttacgatcatgaacagcatagagaataaagggcagggcaagtaccaccaggaaactaacaaccagtaattcaacatacatatcggtagaatcaccctggatgttatccggcggcaggaaggaaacaataaacgccataattgaagtcagcagaccgacaattgccacgaccagtttcacccctttaccaccagggatattaaatgtgcgttttaagtcaggatgtttaagaaccaacacaatgtagccaataaacagcatgaaataagcacacagataaatcaccaccgtcagcgccagtgcgatcaggaaggacatgttgttaccgccaccggtattggtgaggatgatcaacgcgatagacgtaatcaccagctgcgaaatgaccagcgttaccggtacgccatttttgttcattttagcgaatgccgctggcagcaggtttttctgcgctgttacatacatcccgcgagaaggaccaacaatccaggaggcgatttccgccagaacacccagcaacagcagtgcggagatcacgcgaaccgtccactcaatttctggtgccacatgggacatcagaacggtaaaggtttgcattacccctgcggagaggttgatttcattacccggaatgaccatcgcaatagacaaaccaccaacagagcttaagcagattgccgccaccatcagcagtaacatagccaacggatagtcgcgccctgggttgctcatttcattgacgtgggttgcggatgcttctacgcccatataactcaaaatgaaggcaacaaatactaccagggtgcccactttagagaagtcagggaagaaggtcttcgaatccatttcgatagcaacgggggcaccggagtgcagataaatagccgctaatgcgatcaaaataaatgcaggtaacaggataccggcgaagaagccaactttagcaattcgcgccgtgtatttcgtgccaccaaactgcgttaatgccagcgcccaaagaatgatgagtgctgcaatagttttggtaatggggtcttcattcagcgctggccatttcaggatgtaggagagtgcccctaacacgaaatagagcatcggaataaaaccaatggcgatttgcagatagccaaatgagatcgctgcaaatccccatctcggccccagagtatttgatacccaggcgaagacaccaccttcttcccagccgtcgacggtggccatttccgcagcacaaagtcccacgggaataaaccataaaatcccgcctaatagcaggaagaagactaatgaaaagcccgatgttgcgaaggtagggtattcataaacagccattaccatcgatgccgttatggcaaagaatccaagtaatgtgagctgcttagctttacctgtctgtactgatgtagccatattatccccctaaaacggtattcctgtcggaaccgcacctgttttgttctgaagcgtattcagaacaatattttccgttgctaatgccagtgaacagactttggaaattgtcccgaaacgggttcgtttcgggacaccgttaccgttaaacgttatcaggtatgtttaaagctgttctgttgggcaataccctgcagtttcgggtgatcgctgagatatttcagggaggctttgtagtcttccagcaacagttcagcaaagtccatttcgaagccgcgacgacacataatgcgcatcaccacgatgtcggtggcttcaccgccgagagtgaaggccggaacctgccagccgcgcagacgcagacgttcagagaggtcatacagggtgtatcccggatcttcaccatctttcagtttgaagcaaaccgccgggatgccttcgtccgggcgacccgtacagatgaactcatacggccccagtttggcgatttcatccgccagataagcggcaacctggtaagaggcgttctgtactttggtatagccttcacgaccgaggcgcaggaattcatagtactgtgcaattacctgacccgccgggcgggagaagttgatggcaaaagtaccaatttgaccacccaggtagtcaacgttgaacaccagttcctgcggcagcgcttcttcgtcacgccagataacccagccgcagcccagcggagccagaccgaatttatggcctgaagcactgatcgatttcacacgcggcaggcggaagtcccagacgatatccggggcgacgaacggtgccaggaagccaccgctggcagcgtcgatgtgcatgtcgatgtcgataccggtatcggcctggaatttatccagcgcatcgtgcagcggttgtgggaactcatagttaccagtgtaggtcacgccgaaagtcggcaccacgccgatggtgttttcgtcacaggcttcaatcatgcgtttcgggtccataaacaactgaccggggcgcatagggatctcacgcagctccacatcccagtagcgggcgaatttatgccagcagatttgtaccggaccgcacaccaggtttggtttatccgttggtttgcctgcagcttccatacgcttgcgccaacgccatttcatcgccatcccgccgagcatacaggcctcggaagaaccaatggtgttggtgccaacggcctgaccatttttcggcgcaggcgcatgccacagatcggcaaccatatttacgcaacgcaggtcgatggctgcggattgcggatattcttctttgtcgatccagtttttgttaatggataaatccatcaatttgtggacattttcgtcgtcccaggtctggcagaaagtggccaggttctgacgagcgttgccatcaagatataattcgtcattgataatctggaatgcgacatcgtcgcgcatttcgtgcagcggaaaacgttttgattctgcgatagtggaaatagacttcgcaccaaaacgtgaatcgagtagttccgaccttaaatccgttacttgcttcttatccattttaaactccttaaaatgattggatcgcattaaaaaagtaggatttatcgataaagtaagcaagtgcaaaggactcgtgtttaaataacaaaatcctaatgttatttatcgtgagatattacgcgaataatattttttcattgaaaaacaatacaatatgaaattcttgggtggtggtaaggtgttttatgctgttatttttatgcgcattctgtgtctcctgaattatcacgtaaaaatcagaccttaaaatatcactattagtacttgattattattttgaacgcatttataaaattattacataaaaatagcgaatattgctaaaatccccgccaacgatgtgttgacggggctgttattattttggcaataatactccggtataagtatttaccggatgagaaagatattgtttaacggcagtgttaacattctctaccgtcatttgtttcaacaattgctcctgctcagtccatgctgcaggatcgtcatattgaataagactatttacaatagtgttcgctaattgttgaacgctacgctgttggatatcgaggctgcgctgaacgttttgctggtattcattcagttcttgctcactgatccctttagccagacgcttaaccatcacttcattcgctaacgttaacagttcatcatgtcgttctggttgacaagtaaaagccagcaaatgactgatatctttggcctgaggatcaaccgagaggcgagaagaaacgctgtatgctccagatgcctgttcacgaatattaacacgtagatcttttgccagtgcgacgttaaaagcatcgagcgccatacgcgtcggcagattaacaggtgtccgggaatcataacgcttccactgtgaaacctgtgccacaggttcattttgttcttttacagtaaccgatgcgttgtccgtcgcgcgagttaatggtttacctgcggctaatggcgaatcagagtgtttgattgatcctaagtaacgcgtaattaacgccacgagtttgtcttctgcgacattaccgacaatgacaaacgtgatatccgctggagatgaaaacaattggcgatcggcagccagcgcatctgcggcagtaaactgtgcaatctgattttcttgcagtaatttcgtgcggtcatcagcatagcgcgtctcatacatctgctgggcgaatttctccgctggacgctggtcgagcgttttcaacgcctgaatttgagcattttgtagcgatgcccaaatattatcgttaatcgtgctgtgggtgattcgctggttaatcaactgaaaaccaggttcagggttattagtccgcgcgctaacggagagcaacgtattcatgccactgactttactgctcatggttaccgaattttccgcactccagcgtttcaggctggaagaggagagttcgccaacgccgcttccgctaactgctttatttgccagcgcgataagtgatttttgctgcgcagggaaacttaaatcgcctttattcgatacggcaataatttgtagcttttgctcttcacccgcggattttgccagaataaccctggcaccattggaaagtgttaatgatgtcagattctccgccagcgtttctttgctgctaatttccgcctgtgggtctgcgtctactgttaacgataaatttctgcctgggaagacgtaagccgccagctttttgttggcgtactccttttccagcgccaggatagccgcaggagacaatgcttttttggcggcaacctcattgtttaccatttgctcccaaaatgcgtcctggttctttcttaactgctgccatttttccgccagactttgcacggtaatttgctgccacagacgtttcgaaagttgatatgtctcttccggcgacaagaacggcgtattatttaatgagctggatgccaggcgactggtcagcatacgtaaatcacgttcagcttgctgatcaaccgcatttttcagccaggtgaggcgggtagatttgacatcatcgagttcttcagcagaaaaaccatgctgatcaatggttgccaactctgccattaatgcattcgcagcatcctgcatattatcgtctcgtgcatttacacggaaaaacagcgactgataatcgggtgcaattttaacgctgcgcgcagtgccgccagaaatagtcttcaactcgcccgactgtatgcgttcctgcagacgttgattgaacagctgaactaacatgctccattcagcttgttcgataaagctttgctcatcgttcacttgtaccattggcaggcgataatagagtgcgatgccgttcacccggttttctttatcattaatgatattaaagcgcaggtggttttcggcttttgtcggccagacgcgattttcagctgctttgttagccggaagcttacttaaattatcctttatcagcgccagcgcttctttactgtcgatatcgccgaccacgataaaggtcatattatttggttgataccagcgttgataaaattggcgcaattgtgccggtgtgaccgtggcgacagtatccatcaggccgataggttcacggtctaaattacgggtatttgccagcaggaaagggcggcgcgcctgagaggtgcgccatttcgcatcctgatgggcacgccattcctcagtaattacgccacgttcagcgtctacttcgagtttttcaaaggttgcggcattactccattcactgaagattgccatcacttgttgcagattttgtttctgcgtagtcggcaaactcacctgatacaccgtttcgtcatagctggtataggcattaacatcgcgaccaaaacgcaggcccattgactcaaatgtttcgatgactttattacccggccatgtttttgtgccgttaaacatcatatgttctacaaaatgagccacgccgagctcattgtcttcttcctgcaatgaaccggtatgaatttgcagccataaatttacctgatcctttggatgagcatgcggataaatcatatatcgcaagccattgtccagttgcccggtaattaacttttcatcctgcggtaaggcggcggcaatcagccgcccggggagcaacagagttgccactaacgtcagtaagaaacagaggtttctcataattatctccatgcgaaaaccgggcgaatttacccggttaagtaaaatccgaactattaaaatttcatgctgacatcaagccagaaagtacggccactggcgtaggtcgccacaccggtgttcgttgtatcaacagcggttttgctatccagtacattgagaatatcggcactgatcgtcaggttttgttgttgcagaaattgtggcgtccaggacaagcgggtgtcccaggtcaggctgctatccagtttttcgtcaacatactgcttgtaatctgaatattcgctgatgtattgcgcatttgtcttaccaaggataatgcgagctttacgcgcttcttgccaggccagcgtattcgcccacactaacccgctcggttgatgcgtgaaatccatgtttaaggagatctttaatgggttattaaaatctgccactggaacgctatcgtaagagaccagattaccgttataaaccacctggttatcaccggtattgctctcctcataaccattgtttaacgacaagttgcccttgctcttgatatagctaaagacaatttgtgggttaatatctacctggcggatatgcaggggttcggccagttcaaaactgaggctgaacgaatgcgttttggttttgccatcgttgttatattcagtaatggtggttttagtcgcgctgtcggtacgactgcttttgctgatttgatcatgcgcttcacggtaaacatagtttgcacgcgcaataacgttcttaccgattttctgctgcaatcccattgccagttcatcgttataaggcgttttcaaatcctgataacgcgtcagagttttattacctgataccgattccgtccagctattgcggatatcacgtaatcccatatcaagaatattcccgccatagtaacggttataacctgctgtaatcattgaggtttgattagcaaaaatatcccattccgtcataaagcgcggggagatattgtggtttgacagatagttgtcatagtcataccgcacgccgggcattaatgacacattacgccagctaatgcgatccgccatatacagcgtgtagttgtcaattcccaggcggcctttacctttatggtaaatggtatggttagttttctttccggcagcattaatcacataggattcagactggttatggcgttcagtccacgcatcggaatagatgtattccgcgccgaagtagggttgatgcgaaacattacccacggcgaatttttgccagtccaggcgtgttttgaaggtgtaattatctacagcctgggaaatgtgtcctaatccgccacgggtgcaacgccctgtaatatcaccatatgtacatgaaagttcggtgtaccagatgtcatgatcgtgacgggtataatcactaatatgatcccaaccaacggtggtacgcagtttggcccatgcgagctgcgtatccatatcccatgccagaccataggatttattacccatttcgcgatcagactgcgggaaggtgctggtattataatcacggctggagccggtatattttaaggttaaatcgtgggtaaagcggtcgctggcaaaccaggtaaatttgcttaatgcagtatcgataacgtttttatactgtgcccgaccggcgacaatgccgtcattcgaaacataatccgcgcgggtgatatcagactggcggcgcgataaaccggcggtaacgccgaagttatcagcgagttcctgattaaacgacaaggtataaaagttctttttaaaatctggggagtaataagtacttcctgaagagccttgattaaatgcgctcttgttattctcatcgatatgcgatgttaaccagtccgaacgcgtagtgcgataacccaatttcaccttgctatcatcagcgttgaagcgtttgatctttgcatcaattaccccgccattgaagcgaccaaattcaaccggcacaaaactgtcataaagcgtcacattgtccagtaagctgacatcaagataatacccctgtgacatcccgctaatattggttgcactactggcatcggactcattcgctgggttcaggttattagttgcactaataccgtcaatcaaataggcattctggtagggcgacgcaccgtgaatagagattttctcagggcgaatatctccctggttcaacgaggtactttgcgttgaatccatgcgtaccgcagggttggttctcagcagatcgctgatattgccattcccggtcggtaaacgctcgatgctttcactggtgtaatgcgtgttgccgtttacgggtacagggacaggagcatagaccgtcatctcttcaaaaaaatgcatgtacatgtttttgtcatcgacggcctgcgccacatcagcgccacataaaatgacgccaggaataagaactcgcttcatttatttatatctccgtacagcagggcttttattgtttttataaaaccgcgctaatgtcacaaatatcatcggccaggttccagacaccgggttgatgtgtaaccataatgacgccgcttgtgggtagtttttcacgcactaaacgcagtaagcggatagcctcttgttcctcaagatgagaggtagtttcgtcaagaaatatccatttcggacgtcgtaaaattaatcgtgccagggcgatacgttgtttttcgccgctggaaagaatatctccccagcgatcgtggtcatgaatacgcgcagccaatttcccaagaccaacctgatgcagtacttcgctcaacgatttatcgtctacgggcaggggaagtgctttacaaataatctctttcagtaagccggttttgattaacggtgtttgtgacacataccaactgtcagcaggagaagaaatatcacctttaaaccacggccagcagtgggataatgttttaagcagtgtggtttttcccgcgccagagtagcctttcagtaatagccatttgcctggcgaaacatgaaagttcaggttctctaatatgatcttattatcaggcgtacgaatactcgcatcagccacttgtaccgcatgttggcaatttttaggcttattcgtagggcgctgttcagtgagttgatggaactcatacaagcgatcgataaccgcagccagttcagcaagttcgtcatatttataaataaaccagcttaaattgttcgataccagcataaatgcctggcgcgatttcatcagtccgcccagattgatctgcccgctaataaactgcggcaataacagaaagtagggaagaacgctaagcgagcgcgaataaatattctgccagtaatcaagccaccgctgacgattcattaaacgatgccagttctctttaatggtatgaaaattgtcgctcaactcctggcgttgtagagactcagcattgcttagcgcaatcagttctgcctgcttattatgctgcacaagatttgttcgaaatgtcgcttcgctacgttgtttttccacattaagcggacgaatacgtttacccaccttatgggtaaataaagttccaccgatcacaatgagcacgacggtatagaccatatacccctggatattccattctgttccaccaacagtgaatgagagcgtacccgcgctttcccaaagaataacggtaaaggtgatcagcatgctaagtgactggatgaagccaaatgaaagactgagcgttttgctgatcagtaagagaatgtcttcagcgatacgttggtcagggttatctgtatttttatgctcgccgtagatctgcgtgaagtagtagtttttatctgcaaaccaccgattaaggtagtaatctgttaaccattcgcgccagcgaatagtcagtagtttaattaaccatgttttgtttacggatattaatacaaagatccccagcagggcagggaaccaaaggacaagctgccaaagcttatcggtttctttctggcttagcgcattgaaaaaatcattattccagtcgtttaaccagacctgaattttaaccacgccaaggatcatggcgaggataataatgattaacaacactgaagttttattattcttacgcagccaaaagggcttcaacagacagagatactttgctatcaacatacgaagcgtaatgggaatggttatcattagcgaaaattgattgtgccatccaatgattatctatggcaatgatttactgatgaaatttatttaagtatcatttaacaatatgaaatataaaggaatatttcattttcagtggttatggttatgctattgataatcaaggatattgctaatgccctgatgcataccacgtaagccaggattttcgcaagggaagatgatgatgacgaaacacccgacaggaatttatgtcgggtgccttgttaaggtcataagaaggaggctaagaatggagttaaaagagagcgttattaattattctccatttgttttgcaacatccataatgtggtaaagcggtactctgttcttagctaactctaccatggcgttcatataaggtaccatggttgaaaaaaggattttataaccttcgcaaaaataagaaacagtctcattgtttactttagtaatacgatgcttaggacaaccgccattgcagataggtttatatgcacattgctgacatttcgctggaatccgttttttttgcgctgtcagttgtacactgttcatcgttttgagttcagatttattaatgtttccaattttgtactgtggatagacaaaatggtcgcattcgtaaatgtctccattactttcaacaaccagattatccttgcaggactcctggaaaatacaactggtatgcccattccccaaaaaacggctgacaaagctttcaaactgacggatgaaaatttcacccacatcgtttttaacccattgcataaaaatggttgacataaacttgccataagccgtgggaggcacagaaaaatcaatgatacggaatgtgttctcactatgaccactgaaatcaatattcggcgtcccggtttctagcaattcgataaattgcatatgtttactgccgatagattttaaaaaatgataaacctcaagagggtaatggacattaacgttattaatgacggttaacgtattaaactctacttgatatgatttcagacgctcgatggctgctatcacttttgcaaaagtaccgttacctgaattactgcgtctgtaacggtcatgtaactcctgggggccatcgatcgagataccaaccagaaattcatgttctttgagaaaggcacaccattcattattcaataaaatgccattcgtttgtaatgcattaaaaatacgtttttggcctgcatagcgttgttgatagtgaataactttacggaaaaaatccaggccagccagagtgggttcaccgccttgccaggtaaaatagacctgattgccagacgctgcgatatattgtttgatgaactctttcagagtgctgtcatccatccatttttcatgagtaaactgcgactctttttcaaggtaaaaacagtaatcacatttgagattacattgaaaactggagggcttggctgtaacgtgcatcgctatctcgctcaataaggcggcggaaaaatccgccgcatgaaggtttagttatttcgcttcgcttagtgctttcttgatattgttaaacttctcctgatttacctcgctaagcggtggctggctgctgtcgataaactctcttaccacgccttgcatctctttaacgacctgcggattggcggcggcaaggttatctttttgctgtagatccgtcagtttgtagagacctaactgattgttttctactgtatagacaagcgaataatcgttatttctcaccgtataagagaattggcttaagtcctcagtgttggggttatgcgggtaatcgtctgactgatggcgaacaaatttgtggtaattatcccagaatggaatattttcctcgtcaaaccagtgagaataagaggttatccaggtcagatttttatgtggctcgccttgtttcttatcttgcaaccagggcagcaaggaaacgccatccagcttaaggtcttttggaatgctgatatcggctgcatcaagagctgtcgggtagaaatccattgcggaaatcagcttgtcataattaccgggttgaagttttcctttccaccacataaacattggggtgtgagtaccgccaggataggtctgactcttatagcctttttgcgccccgttcagcggcagaggaccatcgataaccgcaccattatcggaggtaaagagaataattgtattgtcatactgtccgtttttcttcagttgttcgagaatgcgttttacaccctgatcaacagaataaacggaagcgtagtagttatctgctgtttgactaccggtattaaattgcttctgatattgatccggtgcaggattatcatttggcaggtgcggagcattataagccaggtaaagcataaaaggctggtcaagtgttttggcacgatcaacaacgccaattgcctcatcggttaactgatcgctgatataaccttttgcggggacacgttcacgatttttgaacagtgaaggggagttgtaatatgccgttcctgcagcgtggaatcccataaagtaatcaaagccacggttttgaggttgccattcttccgcagaaaatgtggtgaagttgtcatgatagtcacgcgtttgtttatcttccggtaccggcacattactgatttttgacaagtgccatttacctactgctgcagtgtaataaccatgattctggaataattcaggcaagaaagtttctgttagcggaataccatcctgagcatcggtattggaatagacaccaaagcgggcgggagctcgaccggtcattattgcggcgcgggaggggccggaaacaccgtgtgccacatagccgttagtaaaacgtacgccttcatccattaatgaaaggagcgtcggcgttgatttttgtgcagcttcaatggctttatctatccctattttgtaggtatcgacaacttcacgattttccattgtttttgggtcaaaagatcccttatcaaaaggaagttgtccataaccaagatcatccatggtcagtacgataatatttggctttcctttggtactgtattctgtcggcgtaaagtctgagaaagcaacgtttgttttggttgctttcagctttacatcatctgccgcatgagcagcaaatgcagccataccagatgccagtatcaaagatatcgaggtacttacgacacttttctttaatgcagacttcataaatgttcctcttcttattgtacttaattccaaagtaattttacgaagagaaataagtggatgtaagtgaagttagtcacataaagagatagcagatttagctaaaaaaagggaaaaaacagtccataaagcgttgacattactttctgttctattaagtaatttctcgccgataaacaactaatttattgatatttaataaattattgcattttactgacaaaatgcagaattgagatcataaataatcatgcaacaggttatgcaagtgcataaatatgtgatggatgtcacttatttatttcaataaatatatcgcctaaaaacaacgcggggcagggaatggctgccccatttaattcttacgcagcgtgtgtggttgactactcgttagcaaataatcaaatagctaaagcattcatcgtgttgcccgtattcatacccgtgtgactttgacaacggtactccttagaaactctcttcggactgttgccgaaatgtttgcggaacgcataaataaaataagatgtactggcataaccacattgttcggcaattttattgactgaaccttctacgcgtatcaaattttttgcgtgctgcattcttgcatctaaaagaatctgtgagaatgtcgtttgctcttgcttaagttttttcttcaacaggctttcactgatgtacaggcagtcacaaatatctttcagcttccatgggtgcgccggcttcatgttgacaatatttctcactttcccagaaacggatagcacaccgttagttaatagtgtaatgaaacctttgcatgcggcaaaaatagacaggcaagaaaaaagcaaaagttctgaaaaattatgatgattgcgttcttccgagttgagataagcaatcatttcattaagcaatccagtcggtacatttgaagcacgtaaaaacttcgcaggaacaggcaccgtcactgtctggatgttagtgcattgtagatattttttaatggtattttcagtaaatccgatctctttaaaatgccgctcataaggttcaaaatgcgtacgaacagcgttatctaccatcaggatctcgccgtcagagaaggcgtaatctttatctaaaatgttagcgttgaaggcatgatgaataaatataacagaacaaacgagcgacattttatctccttaaaacaataaagtttttatcgatacttttttaacatttcatatttataatttgctgtttgttttcagccttgcaaactattgataatgaaatgtgtaagatctcttgcaatgcgacccatttctgaaatactcagctgatcaattgccgaaaaaatggctatcaacgtaagtgtcagtaataagacaaccacaattgcagacatgatttctttatagttgtctctttgcgtgattttgtttttcactgtggtcgcatgcatttcaaatatgtttatttagcggataacgttaaaaatcgttaatcagtatgcttaatataacaggctggagaaaagaggaaataggactggtgcttcagtactgagcggagtttcttacagctgtaggcagaagtttatatcttatagtatgtagtttaatttaatccatgtgagcaaattgcgaaataatagtcaatgaggaattcttctgctgtgcggatgacagcagaagaaatgagaagaggcattaatttgatggttctaattcaaccggaatacttttatagccaggaatgccacttaatggatcgtggttatcaagtgttagcatgtgattcgattctggaaaataggtcaccagtgagcggtcagccatagggtaaatgaccacttttaatctatccatgcggcgtgagctgcgcttaccgtctggcgtaagcgcaataagattaactctttcgccgttttttacacggcaaattttagcttgtttagcactcataaagaccacatctcgttgaccgaatacccctcgatagcgatcatccataccataaatcgtcgtgttgtactgatcgtggctgcgtactgtcgccatgaccagcttactgttaaacgctgaagagggatcttctaacagccctttgctggtaatgaaattagccttacctgacggcgtcatccagcgcctttcagcagctgcatttatcaggtgaaaaccaccgggatgacggatgcgctggttatagtcggcgaactctggcagcacagcttcaatgtcattgcgaatgcgatcataatcttccaccagatactcccaggctaccacgctctggggtagtgctgcctgcgcgattcccgcgaccactgcacactctgatttcagcattacaccggcgggttttaacacgccacgcgaggcatgaatcatcgacattgaatcctcaacggttaccgcctgcgcaccgtttttttgcatgtcaatctcgctacgtcccaggaccggcagaatatagctatgccgtgcggtcaacagatgagagcggttaagcttagtggctacgtgtaccgccaaatctaattgcgttaacggtacagcgctcgcttcccgatctggcattgccagcgcaaaattgccccccatgcagatcaatgctcgagcctgccccgtacatattgcttgcatgctggcaattgcagcatgtccaggtgcatgaggtggggtgaagccatagcgctcacccagacgagccagaaactctgcagacggtttctcggtgataccgacggttcggtcgccctgtacattagagtgtccacgtagtgggcagatacccgcaccaggcttgccaatgttacctttcatcaacagcagattgaccagttgctgtacgttctgggtaccatgttcgtgctgagtgatccccattccgtaacagataatggtgcgttcggcagcggcatatgcgtcagccagttcggcgatttgtgtctgacttagtccagaaatacgttcgatatctttccactcggaattgagaacgtcacggcgtagctcgtcaaagccgacggtatgcgtttgaataaactcgtcatcaagcaatgaaggccgacctgcggcgcttgcagcatcatcgcgctcaattaacaggcgcatcatccccttgagcaacgccatatcgccaccaatgcgcacgttatagtaggcactggccaactgagtctcagagttcgtcagcatttcaaacgggttttgcggtgcggtaaatcgctccaggccacgttcctgtagaggattgatggcgatcattttcgctccccgtttcactaaagcgcgcaacgaagtcagcatgcgagggtggtttgtaccagggttatgcccaatgcaaatgactaaatcgcacttctcaaagtcttccagcaacacggtccctttacctacaccgatactcgctgccaaacccacgcttgtcggttcatggcacatgttggagcagtcgggaaagttattgctcccgtattcacgggcaaaaagctgataaagaaaggcagcttcattggaagtgcggcccgaagtatagaattcaacctgattgggatcactatagctttgaaggcgtgcgccaatttcgtcgaaagcttgttgccagcttaatggcttgtaacagtcgctgacggcatcatatttcaaaggctgagtgagtcgccccgcagcctcaagctcgtggtctccccaggtaagtaatgattgaaccgtattctcagcaaagaaagaggcgtttacctgcttatccgtgacttcccaggcgattgcttttgcgccgttttcacaaatgtcgaatgacgcactgtgcttaggatctggccatgcacaacccggacagtcaaagccctctggcttattcatgtcaaacatggcaataacatcctggcgtatatccatctgcttacgtactgcattcgctacggatttaacagcaccccaaccacctgcagcaccctggtaggattcaatttttttcttcatctacttatcctgtgtggaaatgaattattaggatttgtaatagcgatgatgcacagtacatacaaagggattatcgccaacatggatatataagagtaggggactactctctttctatttttaatctattatcgttaaacaatagattaaatacgataagttaagcatcatctctcatagtgtttaaattaacatatttttcaatataaaaaataagactctggcttcaattgtgcgcggattttcttacaggtgtaggctaatagccttcacaaaataattatccgcgcaattttcgtgaatggagcgcatagactaaggtcaaaatcacaattattcatagataaaagtgacaccaatgactgactggacggttccggctgaaaccttgtttcctgtttgtccataggttgcgcttaaacccagaggtactttgcttttatttactgtccccagggagacattttctcccgtagccagtatttttccattacgcattagagtgacacccactcccgatgcttttgttgcatcaggtgctgtgttagcaaacacttgtcggctactgtcagtggtggcacccgaaagataaaatgagagcttttgttcgcttgagcaatatacgccaaggggtatttctgcgcttccaggaaagtccgggagatccacggtgacatttcgactatcaacggtgcagccgcctgttggcataacaacattgttatttgaaataatattccacgtaaaattacgcggatttccgcttcctaatgttgcaattttatacatatgaatacgggcaatgacttcccccgcttttatgacaactccaccggccgccccaactggggtaatatagagttttaacggtaatggcatcggtgtcttatcaccaatatccaatacgttggtatttgtcgtcaacgggaaggggtaggtcacattattccagtacagcgatcctttatatgactgtagggagcctgcgaaagctgagccttgtaccaggtttatatgatcagtgtcgtaccagccgccgtaatcattccagcaacttatatgctgagacaagtctacaaccagattctggcccggctgtattacagggtcgagattaacataaacagaggttgtacctgctccaatacttgacccgccatcgacattacaactgaaggcaaaaactttgcctgccattaatagaagataaataccgaacaggacctttatactgattgttttacccatgatatatcctaaggttaaaaattgatttaaaaagaaggctaagaaaatcgaatcgacgttattgccaggtgtagatcacattgattagcgcctcgatcgttccctggcttgcgtttccattcaccgtgatagctcttgccttaagtggaaactgtgcattacgagtgatctcatcaacaataaccgttttgctatcgccattttttaacgcagcatcctggtcatccctcagctctatctgaatattttcggcagtaccttcatttttgtaataacccgtattgtcagttgaacctgtcacgattgccgtcactgcacttgtttcaaccggacaatcggttaatgacaaagtaatattgtgccagccagatgcagaaccaggttgttgcagattgcgcgtataaagatccccgagattaacgttagcttctttggtttgaatagtgcagggtttagcgactacccgaccattaacagtgatagtgacatcggcggcctggagagttgctgtgaataacgcgcaaaacgtagctaacaggaacctcttgtgaagtcttttcatatctgactctgattattgaaattcaagggtaaaggttgccgaagccctcaccagtcccggattgacggacttctgagttgacttcagacgagcggagtaaggcaaaatattgttctgttctggtaccagtgggatccactgcatcccggcatgaagatcattcagtttcaccggacgcatatttgcgtccaatatttctatacccaaaccggaggccgtattgcttccttcatccagtttcaacaaagtattattttctgcatcctcaataccgttaaatgcaacccgaacccccgttgtccctttgctgcattcacttaacgtaatctgaaaagggacggctggacttgtgctaccggtcgttggaaattgtctggcactgtttttttggagatctacggtaaaattaagcgaatccgatgagactgtgcagccataatcgaggacgcgcccgctaattttaataacgctatctgcggataaagcagaataggtggttaaccccagacataaaccgaggaaaataatgttattgtatttcataatctattgttccttagcgacagattgctgtctgctggttcagtaaggtaccaggagaaacttcaggaagcttgtactcgacaatacagtttgagtttttatctttgccccatgaaacctgtaattgccctgactgtggaagtccagtcagataaacctgaccattttccgcgacaatgctgccatttttattctctccgtgtgtgacaattgcaccgaatggaacgctcttattaccgtacttcaacgtcattaatactttcccgccgatttgtgcattaaatgttgctctggcaatagcaccgtgagttgggatgacagtgaccacggtttcatccagttcaacattatctgcaagggaattcgcgttaagagcaacacggttttctctatattctgtcgcaaatggtaatatggcatagccacgccagtcggtatgaattccggtctggttctctattttgacattatcagcaccaggagccttaaccagaaccattgtgtcgcccagcggctgtccaaaggtgatgccatcagcatgagcaataatcccaccactcattccgtaataaatctggctgctgtcaccactccgactgtaaccgacattagtattaccataagctccacgataattaagagaactgtaaccactggtgccagacgatgtattacctccgtgggtgttaccgacctgaacgctataattcaggttattatccggcagcagagtgccataaacccccgatagattggtcatgccgcctttcaaatcgtttgacatactgtaactggcgtttgaattacgaaatgccgactgactgtctgtacgcatccaatgactgaagggaacattaagcgtaaaagcgagtaaatgatcccgatcgttttgccatatattattggaatagctgtaattcagcgaagtcgtaatatcaccaaacggcacatttaatccaaatgatatttgctggtcgctgcgtgacgtgttccagtaactttggcgactggcactgaaaaatgtcgtaccgtaatttccaagctgctgagagatgcttatttgttcctgaccacgcttactgtagaacagattaaaataatcaataaattgtgtctgctcattggtgtctccggtaggaggcttgacggtgtaaccactcattcgactgtaggcactgtcggataagttataaaaaccttgcgtagaatagcgatatcctgcgacctggatattggttccacaacaagtttattgctgcacttgttgaagagagtatttgcaaaaacattttatgtcgctaaataacatgacgatttcattatgcatgttatttataaaccgtgactaaacagaatattattgcgaacaagggaagtgtcaggaaaggtcaagagctaccaatggttaatatggctataaatcattagctatggttaatgtttgcttgctgaaactaacaccgaattgctctaaacagataagtgcagggtttattaaagctgtccgacagactttcttaacctggtaatatctctcttgggtgactctccaaacatccgcgaatattcccgactgaaatgggatagctttcgtaaccgacagcataggctgctgtggtgacatcgtaatgttcattcagcatctgtcgcctgacttcattgagacgtagccatttctgataccggagtggactcattcccgcttgatccgtccttaaataagtaacagcaccctctggtgttttcgtatgcagtgtctatgcgacagacactgcgctcttagcatggggcagggaataaccaggctatttctccatgcacaggccaattatgaaagaggagaggcttaagttcttgaaccctgaacgaataacgactaccagaaaagcacttcgcatcactcagacatgatttaacataatatacattatgcgcaccaatataaaccaaggaagaatccagtcgttggcggtcatgattgtcatgctcattaacaatgaccaaaccccatatctcacttactaccgtattctcggcttaaccgtccatgcaacctcaacacattgctttcaactgccgtcaccacgttctccggaaaatctgtcggtaatgaagtcttcacgttatccagtgctgctggaatcattctggcaaagtcactcaggatttcatgcatctgcacttccgggaatctcagcacctttgctgtcgccaaaaaatgtcgcggataaattttatcgattgccgtttttttgcctttggatgcgttaagccccattgccagtttgagatcgctgatgtgtattcccgtaccgccaaggaccggaaatgctgaaatgatgtcgtaaaatggcgtgagtcgataactgccgccagcctgaataaatacggagaagttttttgcatgaccgtccgttgcgccaatcaaccactggaagacctggaatttcataaaatcatagcgatctttcagcgcctcgctggaccccatcaaaaaagccatgatccgcgcgatgcctgggcctccatctgattcatatttcaccgatgaaggtaaaccgaatgtctgacacatatcctcctgtggcaagcgaagtaaaaccgttcgctcagcattccaacgcctgtcaaaacgttcgaccgctaacgcgcgcacatttcccgctttaatgatttctgcgtccggaacattcaacccaagttctttcgccagcagcagacagtaatactcattatcaacgctttggctgagatcgagcgtcgcattgggctgcctgatttcgccaatcggtaatttaatgatgtgcgtcgtcggcgttattcctttcggaatgcaccagtcattgcctattctgagcagtgctgtcttctcctgtgcgccagcaaccgagatgcgaaagtcattttcttctctaatcatgcctagcgggatatctgctttataagccgttaatacttcttcaagtctggcttcagtaagcttttcccatgccattatcggatgcgttacggtttcgtcttcgggtattaacgtcacggcaccaacgctgtctcgccctatttctgacaataaatcaaacggttgtctggatttggcatgataacgtttaacgatccggtcacgtacaatcgggctatcgggtaacaggttatcgaagaagttaaatacggcatcagaggtgatattccccctctgcaatggcagcgaaagtgacaacggtctggcataacggcttgctaaccactccggtgcatacttaaaggtgtgcgcgccgttggctaacttcgttaactcgcctacccgctggttgttcatccaagtgacaagtttaggcattaccactccagattttgctgttctgttgattctggcgaggcatttttcgcgtcgcatagcgtcattgagagttcaagcgactgtaaaatcttaaaaaatgtcgtgagcgtggtattgtcagggttgttttcgaaattggaaatcgtcgcctgcttaataccaatttttttcgccagctcgctctgcgtccagccattttgctggcgaaccagtttcattgcattcgccaattgcgttgggctatagatcttctgaaagctcatcatgtcatacgtccacagcaagtttatccgcttaaggggatattataagttttatcctttagtgaggataagtcaatctggaaacacatcttatccgctctacgggataaacgctgcgatatccgcgatcgcggataaaaaggaggatttaaataaggcgttgatgcgccgtttgaagtcggcaatattaagccgcatgccatctcgacatgcggcttatacggtttaccagctatatttcactcccagcatgccctgagtatcgctatagcctttatcacctagttgcacaccgacattcccccacaggctaaggttgttatttactttcgcctcaaccccggtacgtacttcaccgagattacgcgcaccttcacggcctacggtttgaccattcatcttcacggcgtagactttgctattgttgatccagttcgcttcaatgtaaggctggaactcacgctgtttaccatcgtcacgctggtgatggctgttcaggtaggttttcaccccaagtcgcgtttgcacatttccgtcgccttccgtttcaatgcgcgttccgtctttccgggtatggtcggaatctttcacacccatccaggtgatttgcgcctgtggctggacgtaccaggtattcagcgtcccttcgctgccgctaaatgttcccgcttcaaaggtatacccaccctcaacagaggccgtcacaccgcgagaatcatagtcgtcagcagaacggttatcggaactgacgctgttatcaaaccagttatacagcgcccagctgtcaacataagcgccggtcttattcgcatcgttctgataccaggtcgcgtacagcccagcgctgtaaccgctgatgcgcccatccgatttataacccacacgattactctgagtattactgtgctgattggcgtagcctgccatcacgccaagatgccagcgatcctgcgcgttgctactccactgcgccaaatcgccgcctagctgcaatacatagcggttagcctgagtatttagctgaccgtcaccggcccttgaacgttcgtgccctccgacatgacgcatccacatactgcttgccgacccctgagaatgcagtgaatctgtatactgcggctcacccagacggtcgtgtaaacgatggctaaacagcgagttggctgcggcaatgttgctgatatagcttccggcctccgggcgataaactgatgggccttccggatccacaacagggggattattgatgggatcgggtgtatccgctggcgttacgccgtcccatttactggtcagataccagtttttctcgtcattccccttccctttagccagcgtgtagacgtaagccccagcttcgacagttccggtggtcagcgcgaagttacctgcagaattaccgccaacctcaatgagttcaataccgttgaccgtttgtgcaccgacgccgccaatgttatcaacccgaacgcgagtgttcccttgggtatcgcctttcacgttcatcttatcggtgggcgaattatcgccgcccagcgtcgcgttgaacgtcatcaggccattgtttccggtatagttgccgttaacggtcagtacattccccggtttccccccttcgctattcatttgaaccgtgccgccattctccaggttgccgccgatagtggttttagcgacacgcagtgccccccccaggcataacgttcatatcacctgcagtggtgacatttcccgacatcacaccgctgttatggatattaatgtgttgacttgccatattaatggcagagtcggaaccgaaagcaatttccccccccacgatatccgtcgtaccctgatacgccgcggaatcgttgttaagagtcaggatcccggtacccagttttgtcacatcaccgctaccgctgatactgtgcgtcatcgcccagctacgctcagtggagatggtgagcaggccattattgataacggaagcatcacccaggtttttctgctcgttgacgctgagcgcgctgcctgtatcaatgttgaattgccccacaaagcggctattatcgccatccaactctacatctgtcctggcggttgcgctcacgatacccttcccgcttatgctattacgcagttcgccagtcacgttttttagcgttaacagaccgtcattggcaatatttcctctgcctaacccctgagtattatcgaggctgacttccgcatttgggctaatgctggttaacgcattgtagcgtgcattaagcccctcgatagccagcgttccccctgtaacattcaggtttccgccacctgtcagttcaccctgactgatcccacctttatttaccgtcagcgccccctctttgaacaaaacagtcgaacccatctgcccggtgaatgtctctaccgtctgcgtcgatccattaagatcgacgatggccgcgttgctgatgttcagttcccgggtgttgccaagtgcaccatccgcatcggtacgtaatgtccccatctgaacgtaggttgccccctgatagtcgttctgaccgttggaaagcgaaacctgtcgcaccgtattgattgccagatccccttcaccaccgatttttgccgacatatcggccgttgcgccataggctccgccatgttcggctaacgtcagcttttgcccaccatggatgttcagcgctttcagcccatagttaacgtacaaaccattacctggtgcggtcgtgaggcggaatccataatcaccctcggcgaccaccgttccgttttgcgcaatgtgtaacgttttgtccgcttccacctcgtcgccctgtaaatcacgtaacgttaatgagccacccgacccaataaccgtttgcgccttcaccagttgaacgccgacatggctatcgtcgtgttccagcaaattgagcgtcgtcagagggttattcgccatgggatcattccacggtttaggcacgtcgataagcacgtcgcccgtcccgtttacctgatagttacggcctttccaggtgtagtcacccgcgccgacaaccagcgtatcgacgctgatatatccctccgcgagcgtcgcagcaggaatatccgtatcgaaaatgatggtacctccattcatggccagtccaccaatggattgctctccaacttttaccgatgtggtattttcactgtcagactgcaacatcgcgtgagtaagcgcagcggtgttgtcgcgttccagagtgaaggtactgtctttcagttgggcaacaccggcgaattcagtccctgttgcatgggtaaagccaaacatcttgtcggaggatgacagctgcactcgcatcaagccatcgcctttgagcgcattggtcagcgtgtaatctcctgcactgttcgttgatgcgagaatgtcgagcgtaccggggtttgcaatggttacttcactcgaccccatgcccgttaccccatctgccgtatgagacgcaatggtcaggaggccgtcattgaccagcgttttaccgctataagtattccctgcattgaacaccgtatggcctgcatcatggatcacttttccgtctttatcgtcacctgtaatcagcatatcgacctggtagccggcatcactgttattggtatgattaaagacaaaaacgccttcgccaagaccaaactccactttcgtcgcattggtgataaatccggcatctgccgccgcctcaccgtgagcagcaccaatgtttagcgttcctacagcaggctcaaaaacacctaagtaaacttctccaccttcgacattcagcgtaccgttattcgtcagggttaacgtacccgtaccagatgtccctacgtacatattgaatgtttcaagaagagagttctgcccatccaccctcacgtcgcccttacttttgtcattgagagctatctgtgtatcacgcgctttaactatacctccggtggtaatattcagttcacccgtgcctaatacaccgacctgtagcaattgtgcgttagtagatgatgtctttaaattccagagactgtccgttgaaatattaactatccccttaccggaggcatttcctccgataaatccatagcccgttgaattaagggtggcaccattactgacatttacgataccgctaccaaaattaccgacattgatacccacagtatcgaacgatgatgtcgcatccatcaggttcagtgtgccgataccgcttgctttatcgcccaaaaaagtaatattttgcgatacgaacttaccgccatcgctaatattgaggtttccgacgcccgcaacaccaatggtggtatagacattcttattgacctcccacattccccccgtggtgatgctgacattcccgacgccggtttctccataaccgagtgaacttcctccgttgctgacaacaagcccctgattactgatattcatttcgccgtggccgtcataaccaagattagttccgagattagtgataacggagttcttatccttaacagtaatgttgcctgtgcctgtttctttcatccccgcagtgataattcccgaatctactttgccttcactcgagacattaagttcaccgtcgccagcatcaccgatatagatatagcggaaagcttcgcccgttccgaggaaattccaatgccctttatcggtcacgttgacgacaccgtgggaaccgtcctgaacgcccaccaatgaatattctttgttattaatcagtccattattggaaatattgactgtgccattaccgaaatatccattatagagtctgcgtaccgtgatgacagagtcttgatcctgcacattcagggttccgataccggtggcattgccaccgataatcgtattttcagccgtaaccaaccccccctcgcgaatagtcgcctccccagttccttgattaccaatttgaaattcaattgaggaatcattattttttattagccactcgccacccttttcaacgacaacctggccattactgcccgcctgatagcctaaaatggcgacgattgaactcgtgacgtaacccttatccgtaatatttaatgaacctgtgccatagctacctatttcgaataattcggtcgtcagaacagagtcctctccctcaacattgaccgtcccgacgcctcctgtcgaagaacctaatcttaaatagcctccatcgacgtgacccttctgtttaatattcagcgtccccgttccggattgacccacatttaaaggccttgcattatttccgctatcatacaatcgccaggtgccacccaaaacattaacggtgccctctgagtcctcattagcgccaatgacgctggtagtaatagtggttaaggaggcattaccgccagccaaaatattaagcactccagtgccataccagccaaccaggtaggcatcataagcaacatcagtatcaatattggtaatctgatcattatcaacttccagacttgcaccagacgctgaaccgcttagtgccagcaaaacacccagcgtcaatctactgaatttcgttgtcagtccagaggatttacgcaaattaaccgtcgatgttttacctgccctgcgagttaattccgagcaggcctgaaatacctgtagagtgcaattccatatcacgcgatagattctattcatataaacgctccatatacaaacaatacagccacgaaagagatgagtcgtcagacattaaaaatgaaacttattaaattgtcagaggtctgtattgagtgttagttggaggtgggaaggtgtcaatttggctaatttgctaatgctttcgaattgatagattaaaaattgcatagttcttattttatttaaatatgaactatgagttattgttgcttaataagaaaactgtttctttcaataggaaaattatcatcatcatatttaacaaagaatagcactaattgctaaaaatcgaagtttattaaaccccttttgcatccattagtgtctttaggaatattcgctataaaataagggttgtgcttaatgctttaagaaaaatagcaattttcccttgaatatcgtactggtgatggaacgatgaatctgcaagctggcttttaacaagccagctctaaaagaagggaaataagaataactatactcaaaaactaacagccacggtcatcatgatgtggctgtcaatgaaactataacccaggcgctttccataacgacgtcgtcagtccatgatcaaccagccccagctgatcctgataaactgcctgccacttatcgcgtgaatcctgataaagttcatgcttttccgggtctggtgtgtgcgtccgttcccagcgaaccaggcgttctccggtttctgccattgatgaaaaaattccggcaccgacgccagctgcaatggcacatcctaatgcagtggcttctttgaccaccggaatattgacgggtaatcccgagacatcagcgagaatttgactccataatttcccttttgaacctccgcctgcaaagactaacgatgaaggatgaatattcgagaaatcagcaatttgctgcaagttacacgctgatacaatcgccgcattttcttccagcgcacggaacaatgtcgctttgttacatttatccgggtcaatggacaagttaataaaggaaggcgcagcgtgataccaggttttaaagcgcattctgtcggagaagatcggcattacgccccacgacccaggcggcacccgactggccatctcttccagcagcgtataggtgtcgatgcctaaacgttcggcaatcagtttttcttcggcacagaaagcatcgcggaaccagcgcatggtgagtccggtaaaaaagcttatagattcagcttgtaccatgccaggaataacatgaggattaacgcgcacgttcatttctgggtctgtcaccggcgcggctaaatttacaacttgctgccagaatgtgccgccaagaaccgcggtttgtgccggacgcacaacgcctaacccaaggcaaccaagctgcacgtcgcctcctccaacgaccaccggagtgcccgccttcagaccgcagagttccgccgcttgtgaacttaccacgcccagcaatgtgccggtttctttgacaggagaaagaatatcggcacgtaggccagccatatccagcaatgcaggtttccagtcacgggtggttagatcaagaagtcccgtggtgccagcgttagagggatccaccgccagttcgccgctgagcatataggccagccagtcgctgatcatggtgatggttgatgcctgacggtaaatatcggaacgatggtgcgccagccaaagtaatctggggatggcacttaaagccagtgtttgtccggtcgcgcgataaacttcgttttcaaaggtattgttgtgcagttctttaagttcgctaacttcgcgtgccgctctggcatccacattggcgcaggcccagatcggggctccttcattattatataaaacaatgccttcacgcatcgaacatgccgaaacggcagcgatatactccggggctatgccggcgttgtgcagcgcctggcgcatacactcacacgccagttgccagtttttgttgagatcaaattccatagaaccaggaacgtccggtactgccagatgccgccactccgcctgtcccactgctatttgattgccttccaggtcgaatatcacagcccgaatacttccggtgcctgcatccagcgccatcaggtagtactttgattctgaaagggtaaagagtcgagccattagattatcctcggcttatgcgttctgtctgttcctctatacgttctccatcattcccggtaataaggtcatgcaaatttaactacgtaaaatcgccgctgctgtgtcctgatcggtaaccagtgcgttgatataaccgcctttcattgcagcggcaattgcttcggctttattttctccccctgccacgccaacccggacgggtatggtcttcagcgcgcttaaaggtaagccaatcagttcgttatgtattttgatattcgtgacaacgtcaccttttgcatcaaaaaagtagcctaaaatgtcgccaaccgccccttttcggccaatcattaactgttcgccctggctgatataaccggagcgaatgattgtcgcatcgtcctgttgactcacagcaccaatgccgacaatcgccacatccgctgcttgcgcggctaacagaacatctttgacgcaattttcattttttagcgtacgggcaatgtcagcggaggatgcccgcaacggagccggaataatattcacactgcacgccgcgttaagctgcccgattcccgtcatataagaaccgacgccaccggagagcgtgaccaggcgaatttgctgtgacgaaataaaaccacttaagcgttgcagcgtattcatggttgcctcgccaaaaccaatcgccagcatctgttgtggttgaagtaaactcatcaacatatgcgccgcgcctatccccagtcgcccaccgacatcagcatccgcaagcccagggatcacccggacatgttgcagcgaaaactgacgacgtaattgagtttcatattccagacagccttcaaagcgagaattaatctgtacgcgaataatgccggactgatgccctttctccagcaatcgcgacactttcaaacgtgtcaggccgagacgatcgctgatctcgctctgggtcagcccgtcgtgatagtaaaaccacgcgatccgcgcgacctgttcttcttcacacattccctgttctgaaattgccgaatcgttgattgtcataattcattcttcactttgaacatatttaaatctttaatgcaattgttcagttcttgctcatttatatctgtgatggcaaccacagtttgactctacgagcatgaacaaacgcaaccgtgaaaatcaaaatagcataaattgtgatctattcgtcggaaatatgtgcaatgtccacctaaggttatgaacaaattaaaagcagaaatacatttgttcaaaactcacctgcaaaactgaacgggggaaatatgcaaacgagtgatacccgcgcgttaccgctactttgcgcccgctcggtttataaacagtattcaggggtcaatgtcctgaaaggcatcgattttacgttgcatcagggggaggtccacgccctgctcggcggcaatggtgccggtaaatcgacgttaatgaagattattgccggtattacccctgctgatagcggtacgctggagattgagggcaacaactacgtcagattaacgccagttcatgctcatcagctgggtatttatctcgttccccaggaaccgctgcttttcccaagcctgtcgataaaagaaaacatcctgtttgggctggcaaaaaaacagctctccatgcagaaaatgaagaacttgctggcggcgctgggctgccagtttgatctgcatagtctggcaggatcgctggatgtcgccgatcgccaaatggtggaaatcctccgcgggctgatgcgcgactcgcggattctgatcctcgatgaacctaccgcctcgcttacccctgcggaaaccgaacgcttgtttagtcgcttgcaagagctgcttgctactggcgtgggtattgtttttatctcgcataagctgccggaaattcgccagattgccgatcgaattagcgtgatgcgcgacggaaccatcgccttaagcggcaaaaccagcgaactgtctaccgacgacattattcaggccatcaccccagcggtacgggaaaaatcgctctctgccagccaaaaattatggctggagttacctggtaaccgcccacaacatgccgccggaacgccggtgctgacactggaaaatctgaccggcgaaggtttcaggaatgtcagcctgacgctcaatgccggagaaattctgggcctggctgggctggtgggggccggacgcacagaactggccgagacgctctatggtctgcgtactttgcgtggcggacgcattatgctgaatggtaaagagatcaataaattatccactggagaacgtttactgcgcggtctggtttatctgccggaagatcgccagtcatccggactgaatctcgatgcttcgctggcctggaacgtctgcgcccttactcataaccttcgtggattctgggcgaaaaccgcgaaagataatgccaccctggaacgttatcgtcgggcgctgaatattaaattcaaccaaccggaacaagctgcacggacattatccggtggcaaccagcaaaaaatcctcattgccaaatgcttggaagcttcgccgcaagtattgattgtcgatgagccgacgcgcggcgtggatgtctcggcccgtaatgatatctaccagctgttgcgcagcatcgccgcacaaaatgtggctgtgctgcttatctcctccgacctggaagagatcgaactgatggcagatcgtgtgtatgtgatgcatcagggcgaaattacccactctgcactgaccgagcgcgatattaatgtcgagactattatgcgcgttgccttcggcgatagtcagcgtcaggaggcgtcatgctgaagtttattcagaacaaccgtgaaatcacggcactgctggcggtggtgctgctgtttgtattacccggttttctcgaccgccagtatttaagtgtgcaaacgctgaccatggtttatagcagcgcgcaaatcctgatcctgctggcaatgggcgcgacgctggtaatgcttacgcgcaatattgatgtttcagtgggttcgattaccggaatgtgcgcggtgctgttggggatgttactgaacgcaggatattcactacctgttgcttgtgtcgcgactttactgcttggtttgctcgcgggatttttcaacggtgtcctggtcgcgtggctaaagatccctgccattgttgccacccttggcacgttagggttgtacagaggcatcatgttgctgtggactggcggcaaatggattgaagggttacccgccgaactgaaacagctctccgccccgctgctgcttggcgtttcagcaattggttggttgacgataattctggtggcatttatggcctggctgctggcaaagacggcgtttggacgcagtttttatgccacgggcgataatttacagggcgctcgtcaactgggcgttcgtactgaagccattcgcattgtggcattttcgttgaacggctgcatggcggcactggcgggaattgtgtttgcttcgcagattggttttatccccaaccagaccggtaccgggctggagatgaaagcaattgcagcctgcgtgctgggcggcattagtttgctcggtggttccggtgcgatcattggtgcggtactcggcgcatggttcctgacgcagatcgatagcgtactggtgctgttgcgcattccggcatggtggaatgattttatcgcgggtctggttctgctggcggtgctggtgtttgatggacgcctgcgttgtgcgctggaacgtaatctacggcggcaaaaatatgcccgctttatgacgccaccgccatccgttaaacccgcttcgtcaggtaaaaaacgggaggccgcataatgcgtattcgctacggttgggaactggctcttgccgcactgctcgttattgagattgtcgcatttggtgcaattaacccgcgaatgttagatctcaatatgttgctgttcagcaccagtgactttatctgcattggcattgtcgccctaccgctaacgatggtgattgtcagtggcgggatcgatatttcgtttggttcgaccatcggcctctgcgccattgcattgggcgtactgtttcaaagtggtgtgccgatgccgctggcgatactcctgaccttactgctcggcgcattgtgcgggctgatcaacgccggattaattatctataccaaagttaacccgctggtgattacgcttggcacgctgtatctgtttgccggaagcgctctgctgctttccggtatggccggagcgacggggtacgaaggtattggtggattcccgatggcgtttacagatttcgctaacctggatgtgctgggactccccgttccgctgattatcttcctgatatgtctcctcgttttctggctctggctgcataaaacccatgccggacgtaatgtgtttttgattgggcaaagcccgcgcgtggcgctttatagcgcgattccagttaaccgtaccttatgtgcgctctatgccatgacggggctggcgtctgcggtcgccgctgtgctgctggtatcgtattttggttcagcacgttccgatctcggtgcgtcgtttctgatgcccgccatcaccgccgtggtgcttggcggggccaatatttatggtggttccggttccattatcggcaccgccattgcggttttattagtgggatatttgcaacaaggtttgcaaatggcaggagtgccaaatcaggtgtccagcgccctttccggtgcgctacttatcgtcgttgtcgtaggtcgttccgttagcctgcatcgccagcaaattaaagagtggctggcgcgtcgggccaataacccattgccataaaggatatcttcatgacacttcatcgctttaagaaaatcgccttacttagcgctcttggcattgccgcaatctctatgaatgtgcaggccgcagagcgtattgcatttattcccaaactggttggcgtgggattttttaccagcggtggcaacggcgcacaacaagcgggtaaagagctgggcgttgatgtgacctacgacgggccgacagaacccagtgtttctggtcaggtacagttgattaataacttcgtcaatcaaggttataacgccattatcgtttctgcggtttcgcctgatggcttgtgtccggcactgaaacgcgccatgcaacgtggtgtgagagtgctgacctgggactctgatactaaaccggagtgccgctcttactacattaatcagggaacgcccgcccagttaggaggtatgttggtggatatggcggcgcgtcaggtgaataaagacaaagccaaagtcgcgtttttctactcaagccccaccgttacggaccaaaaccagtgggtgaaagaagcgaaagcgaaaatcgccaaagagcatccaggctgggaaattgtcactacgcagtttggctataacgatgccactaaatcgttacaaaccgcagaaggaatattaaaagcgtatagcgatctcgacgccattatcgcccccgatgccaacgccctgcccgctgccgcacaagccgcagaaaacttgaaaaatgacaaagtagcgattgtcggattcagtacgccaaatgtgatgcgcccgtatgtagagcgcggcacggtgaaagaatttggcctgtgggatgtggttcagcaaggcaaaatttcagtgtatgtcgcggatgcattattgaaaaaaggatcaatgaaaacgggcgacaagctggatatcaagggcgtaggtcaggttgaagtctcgccaaacagcgttcagggctatgactacgaagcggatggtaatggcatcgtactgttaccggagcgcgtgatattcaacaaagagaatatcggcaaatacgatttctgatgtgcattacttaaccggagtaagttatggcagatttagacgatattaaagatggtaaagattttcgtaccgatcaaccgcaaaaaaatatcccttttaccctgaaaggttgcggtgcgctggattggggaatgcagtcacgcttatcgcggatatttaatccgaaaacgggtaaaaccgtgatgctggcttttgaccatggttattttcagggaccgactaccggacttgaacgcattgatataaatatcgccccgctgtttgaacatgccgatgtattaatgtgtacgcgcggcattttgcgcagcgtagttccccctgcgaccaataggccggtggtactgcgggcgtcaggtgcgaactctattctggcggaattaagtaatgaagccgtggcgttatcgatggatgacgccgtgcgcctgaacagttgcgcggtggcggcgcaggtttatatcggcagcgaatatgaacatcagtcgatcaaaaatattattcagctggttgatgccggaatgaaagtgggaatgccgaccatggccgtgactggcgtgggcaaagatatggtgcgcgatcagcgttatttctcgctcgcgactcgaatcgccgctgaaatgggggcgcaaattatcaaaacctattatgtcgaaaaaggttttgaacggattgttgccggatgtccggtacccattgttattgctggcggtaaaaaattaccggagcgcgaggcgctggaaatgtgctggcaggctatcgatcagggcgcttctggtgtggatatggggcgtaatattttccagtctgaccatccggtggcgatgatgaaagccgtacaggcggtggttcaccataacgaaacggctgatcgggcatatgaactctatctgagtgaaaaacagtaactgcggatctaaggagaagaattatgcacgtcacactggttgaaattaacgttcatgaagacaaggttgacgagtttatcgaagtttttcgccagaaccacctgggctctgtacaggaagaaggcaatttgcgcttcgatgtcttacaggacccggaagtgaattcgcgcttttatatctacgaagcctataaagatgaagacgcagtggcgttccataaaaccacgccccactacaaaacctgtgtcgcgaaactggaatctttaatgaccgggccgcgtaaaaaacgtctgttcaatggtttgatgccgtgaggcgaatttatcaattttatctacaattggggtaacgcgctgacgggagtaaaaaaatgtctgactggaacccctctttatatctacacttttccgctgaacgatcgcgtccggcggtggagctgcttgccagagtgccgctggaaaatgtcgaatatgttgccgatcttggctgtggcccaggtaacagcaccgcccttctacaacaacgttggcctgcggccaggataacaggcatcgactcgtctccggcgatgattgctgaagcgcgcagtgctttgccagactgccagttcgtggaagcagacatccgcaactggcaaccggtacaggcactcgatctgatttttgctaatgcctcactgcaatggctgcccgaccactacgaattgtttcctcatctggtttctttacttaatccgcagggcgtgctggcagtacagatgccagataactggctggagccgacccatgtgctcatgcgcgaagttgcctgggaacaaaactacccggatcgcgggcgtgagccgttggctggcgttcatgcttactacgatattttgagcgaagccggatgtgaggtcgatatctggcgaaccacctactatcaccagatgccgtcacaccaggcgattatcgattgggtgactgccactggattacgtccgtggttacaggatctgaccgagagcgaacagcagctttttcttaagcgctaccatcagatgctggaagagcagtatccactgcaagagaacggacagatactgctggcatttccgcgtctgtttattgttgcccggcgtatggagtaaatatcacgtcagctggtaatgacgatcgggaagaatttttgctggaatttcggcttcatcgttcatctgtaacaggtcaatttcaatagcgttgcagatggcatccagtggtaaatcattgttttcagtaccgaacggatcttccagttcttccgccagacaatccagcgaaataaaagtgtaggaaatcagcacagagataaaaggcgtcatgtaatgcaggtccacgaccagcgcgaacggcagcatgatacaaaacagataaacggtacgatgcaaaatcagggtgtaggcaaagggaattggcgtataggcaatgcgctcgcatcctgccaggaccgctgaaatatcattaagccgatcgttgaggctaataaacaggatatctgaaagctgtccattgcggcgctgaaccgccaaccattctcccattattaacaagatacggttagctggagagttcgaagccagtacacgctgaagatcttcagtcttgagataatgagccagcacttccgcctgtggctgtttgcgtaatgtcatgcgtaaacagtgggcgaaagcgatttgcagccgggcaaactcccttacacttgccgaatccggcaatgtcgtttttacctcgcgcagtaacgaccgtgaggcaatcatcaactgcccccaaagttttcgcgcttcaacgtaacgggcgtacccggcattattacgaaaaccaagaaaaatggcgatggcgacaccgagaatgctgaacggtgcgagggtgaatttgatgcccagatgcgtgtaccagggcagcatgaaaataacagcgatagaaaagagaaaattgagtagtaagcgcgaggatatcttggataatactgagccgtgccagacaaaaatacggcgcagccagtgttgttgtggacgaacaatcatggttatcttcaggcgtggaaaagtcgccctattaaacgtgattacgatcacattctcaagacgctacttacaaattacctacaagcttacaacattagcaggcgctgcatgtggcacctgttaatgataaaggcatataggatgttgtaactaatatggtgaaataagaaacccggtcgaaaccgggttcagaagtaacggtgttattagcacaacggacgtacagcttcgcgcatccctttttcgagaatcgcatccaggtcattagcaacctgctcgaccagaccaggcacttgcgtcaggtcctgctcccagtggtctttttctgccaaaacaatcgctaccagttcctgggtgccgataacacggtcacgatgctggctccagagttgctgataacgttccagccagtgtgcatcgtcctgtaccggatatgtttcgccgttacgctcaccacgatagaacgcaatcaatgccgctaatgcgaaagtaaggcgcgccggaagtgtgccgtttgccttctgccctgccagcagctgtggcaggatgcgggtgcggaacttggtcataccgttgagcgcgatagacagcagctgatgcttaatgtacgggttacggaaacgcccggtgactgcactggcgaaagattccagttcatcacgaggcaaatccagtaccggaataatttcttcgtagatagctttttcaacgaatgcgcaaatttcagcatcgttcatcgcttcacctacggtatccagccctgcctggaacgccaccggcaccagcgcggtgtgcgcaccgttgaggattgccactttgcgttctttgtacggtttaatatcgtcaacaatcagcacgttgagcggatatttgtccagacgcagttcagtcgctaaggatttcggtccctgaatcacaaacaggtaaaagtgttcagcggtgtcgagaaaaccatcgtgataacccagttcttcttccagtttagccacttcatcgcgcggataaccggtaacgatacggtccaccagcgtagaacagaagctgttagcctgatccagccattgaataaatgcttctggcagtgcccactcttgcgcatagcgcagcaccagttcacgcaacgcgtcgccattgtagtcaatcaactcacacggaatgatgatccaacctttatccagcgcaccgttgaaatggctaaagcgttcgaacagcagacgggtcagttttgccggatagcttaccgctggcgcgtcatcgaatttatcgcccgcatggtagctgatacccgcttcggtggtgttagagaaaacaaagcgcatttccgggttgtgcgccagtttcaggaattcatcgtattcactgtagacgctgatttcacgattaaccgagcgaatcagacgcgcgtcgctgaccgcttcccccttctcattcaggccacggataatggtggtgtacagaccatcctgcgtgctcagtgacggcgggaatgaagtttcaatcggacgaacaacgaccacgccagaattcagatcggtgtgctcattcaggagatcgatttgccagtcaacaaaggcgcgcaggaagttaccttcaccaaactgaatgatacgttctggatactgtgcaccgggaaaatcgcgacgatttagtgttttcacaatgggttcccttctgattagtcatacaacctgtttgaattggtacgacaggttagcaaactttaatacgccgaacccctgttttgatcaactcctgatgattaatgagcagttttatgagaaaagtgtggcgcggatcatggtttaatcgaggaaaaacgccttttcctggatcataaagtggtagaacacattgcattcaaatcgcgcgtaatgaataaagatgtcagacaacttcctcaccgtaacgcatagtgctggtacggttgcgcccatctttcttcgagcgatacagacacgtatcggcttcgaccatcaatttattaaagtcatcggtcagcgttaggtacgatgcgcgaccactaccgacgccaatacttaccgtgagataaagcgttttttgttgccaggtgaatggttgcagttcaacgcctttacggattttttccgccattagcagaccatcgacaggattcaccgacggcactgcaacagcaaattcttcgccgcccattcgcgccaccagccccttatcaccgacaatcttctgaatatgccgggcaaacacgcttaacactttatcgccacattcatgtccatagttatcgttaatgcttttgaaatagtcgatatcaagcagcatgacagtcagatgttgtgtctgtttcagcgatggacttttcagcgcctcataaagaccggaccgtgagtaaacctgagtcagaaaatcaaagtcggctcgcagcgcaacttgcttcattagcgaattgatcgctgccacgctaaaagaaaccataattgggcatatcgccatcgtggcaataccgagacgtgcggagaacatttgcggaatggagaacggcgaaccgaccgagatatcaatcaccgaatttgccaccagtacgatttccaccgcaccggtgacaaaggtcaacagacatgttacctgcggcgtatagcgcactgcacaccagattaatgcaggcagcgggaacgccagactccccgctccgccaatgactaccgaggcaataaccgacacaataagcgcgatggcgggcatcatctgttctgctttaaagcgcggcagcactccaggaatagccaacgtcagcatacaaggcacgatcaacacgcccgttgagaattgctcactgaaccagtccgcaagcaaaggccagaaatccagactatcaatactgaccgaaccaagatagcatgttcgctgacagcggcggcaaataaaggtaccctgggaatgctattttgtcgttttccgcaattctcatggctgattcatctgtacaaccagccagtgatagattaccgccacgatataacgttgttgttcttcgcttaacgaaacaccctgcggaatgttatgccacttagccagacaaccgcgacagcaggtcgcggtggcgtgctgagcgataaacaccggatgcccgcgcatgggggtttgcttaccgtcattagccggtaatgccggagcaagacgtttagcgacaaaatccgccgcatgttgttcgatgactggcgcgcctttctccaggcaatactgacgctctttcatgcccagacgaaagcgagagcgaaattttgaacgggataaacgcgcgaagagtggatcgagagactgcattaataaaccgaacgccctaactgtttcgtcaattgttcaagaacggcaatacccgcaagcgagttacctgcatcatccagttccggactccagacagcgatggccatttcatgcggaacaatcgccacaataccgccaccaacgccagatttcgccggtagccccacccgccaggcaaactcccccgcgttctggtacataccactggtcgccatcagcgcgttaatttgccgcgcctgcattggcgtcaccactggttcatcaatatgaatagctttcccctgattagccagaaagacaaacgtccgggccagctctacacagctcattttcagagcgcagtaatgaaagtagttttgcagaacggttgtcacgtcatgatggaaattgccaaacgacttcatcagccaggcgatagccgcatttcgcgcggaatgttcaaattcggaacgcgctaccaccgtatcgtaggaaatatcagacacaccgcttaagccgcgcacgacttccagcatacgttgccgtggtgcgcttaatcgcccttgcaacatatcgcagaccaccagcgcaccggcattaatgaacggattacgcggtataccctgctccatttccagttgcactaaggaattgaacggtgatccagacggatctttgccgacgcgttgccagatttcctcttcggagtaatgacgcatggcgacaacgagactcagcactttggaaatagactgaatggaaaaacgttcttgcgcgtctccggcctgaaaaagctgtccgtcaacggtacagatagcaatccccaatcgggaaccgtctactgtagccagcgccggaatataatccgcgactttaccctgaccaatgagcggccgcacttgccgcaagatgttttctaaaattgcattatccatggcgactgccactttctactcctggaccgcaggtctgaaaagacctgcgagtatatcagagctgaatatgtcgcgtcagatccggtctttccacaccgtctggatattacagaattcgtgtaagccgaaatgggaaagctcacgaccaaagccactctttttcacgccaccaaaggccactcgcgcgtcgctggcacaataaccattgataaacaccccaccgcattccagacgtgccgccatctgtctggcctgtgtttcgtcagtggtaaaaatggtcgctgaaaggccgaactcactatcattagccagttccagtgcatgttctgcatctttcgcaatggtgattgccgcaacggggccaaacatttcttcccgaaacgcggtcatttctggggtaacattcgccagaaccgttggcggatagtagttacctgccccagccatcttttccccgcccagtaacaaacgcgcaccctgcgccagggttttctccacctgatgatgcagctcatcacgtaaatcaaaacgagccattggtccgagagcgttctcttcgtcacggggatcgcccattttcaaggctgccgcagctgccacaaaacgttcggtaaatgccgaagcaattccctcttcgataataaagcgttttgccgctgcacatacctgtccggtattctgataacgtccggctaccgccgctttcaccgccagttccagatcggcatcgttaagcacaataaacggatccgaaccgcccagttccagtacgcattttttcagtgccgctccagcctgtgcgccaatagccgctcccgcacgaacacttccggtcaccgtgacagcagcaatgcgcgagtctttaatcatctgactgacaccgtcgttgtcggcattcagccagccatatacgccttgtgggatacccgcatctttaaacacctgggcaatgagctgtgcacagcccatcacattcggcgcatgtttaagtaagtagccgttacctgcaagaatgatgggaacagcgccacgcatcacctgccataacggaaaattccacggcataatcgccagaatcgtccccaacggtcgatactcaataaccgcctgctgattttccaccagcgtaggttccgccttcagcattgccggaccatgttctgcataccagtcacacaaattcgccgatttcgccacttcagcgcgcgcctggttgattggtttgcccatttcgcgggtgatcatttgcgccatttcttcgctacgagcgcgcagagccttaccgatatcacgcagtttttcagcacgataatctatatttgtctcgcgccagtcgcgaaagcctgctgccgccagctgaagtgcgttttcgatatcgtcagcgccagcccacggcagcacagaaagttgttcacccgtggcaggatttatcgaaattgcatgagttgccggagtaatggtcatcggggtatctcctttatgagtcatggtatgaagatacgcagatttactcttgctttaaaatgaataatattaagccacttattcacgaatcgagaatgctatggatctgacccaactggagatgttcaacgcggttgccgaagctggcagcataacccaggctgcagcaaaagtgcatcgcgtgccgtcgaatctcactacccgtctgcgccagctggaaacagaactgggggttgatctgtttattcgcgagaatcagcgtttacgtctctctcctgccgggcataactttttacgctatagccaacaaattctcgcgttagtggatgaagcgcggagcgttgtcgctggcgatgagccgcaaggtttattttctcttggttcgctggaaagcaccgctgcagtgcgcattccagccacgctggcggaattcaaccgtcgttatcccaaaattcagttttcactttccaccggcccttccggcactatgctggatggtgtactggagggaaaactgaatgcggcgtttattgatggacccattaaccatactgccatcgacgggataccggtataccgcgaggaactgatgatcgtcacgccacaaggatatgcgccagtaacccgtgccagtcaggttaatggcagtaacatttatgccttccgcgccaattgttcgtatcgtcgccacttcgagagctggtttcatgctgacggtgccgctccgggaactatccatgagatggagtcttatcacggaatgttggcctgtgtgatcgcaggagcaggcattgcgcttattccgcgctctatgctggaaagtatgccggggcatcaccaggttgaagcgtggccgttagctgagcaatggcgttggttaacaacctggctggtctggcgtcgtggtgcgaaaacacgtccgctcgaggcatttattcaactgctggatgtgcctgactcggcaagacagggatatcaatgagctatttttgatagttcttgcggttaatatgctctatatagtgatgttccgatgacttatgactatatggggcaaatatggttacgccagtaagcatcagcaattacatatctcttcctgatgattttcccgtacgtaatattgcaccgcaggtaaaagaagttttaaaggattttattgatgcacttagtacaataatatgtaatgaagagtggcgcacgtctttaaacatcaactcagccacaaaaaagatatttaataaccttgacaacttatcatatattcagaggacttcttttcggggtaacgacacgctatacaatgaaaaggttcagtttaaactcacttatcccgccaggaatggaagacacaaagaaaatattgaatttcaggtagtaataaatttaagccctatttatttagataattttcgccatgatggagaaattaatattttttgcgctcccaacccaaagcctgtcactatggggcgcgtatttcagaccggcgtcgagcgtgtactctttctgtttctgaatgattttattgaacaatttccaatgatcaaccctggtgttcccatcaaaagagcgcatacaccacatattgaacccctgccttcggatcaccataccgctgcagattacttacgccagtttgatttgcttgtcctgaattttatctctcgcggtaattttgtcatactcccccgattatggaataactctgaggttcacagatggttcgtcaataaagatcctaacttgatcaccgccattctcgacataacggacagcgaattaaaagaggatttgttgcaaagcctgatggattcattaggttctaacaaacatgtactacccgaagtctgcatctgctttttatcccttttagcagaacaagaatctcctcattttcagaacttgtttttatttttcgccaatatgttattgcactatcaccaatttatgaatcccaatgaaagtgatttgaatgacgtgttgatgccagcatcattaagtgatgataaaattatcaaacatatggcgcgcaggaccctcaaactgtttgtaaaaaatgaaacaccgccaaaagttactcacgaagacctggtgaaaaacaggcctcgctcccctgtcagaccacctatacccgcaaccgccaaaacgccagacctccctgaacgtcattaaaccgtgatgttaccgactctctgacgcgtgaaagaatcagcgtcagagaaacggaaaacgcgatccagatcacaaatgcattgtattcacatcattaaccgttttaagatcatttcatcactttttcgcaactcacccgataatctgttatgacaacaaacactgtttcccgcaaagtggcgtggctacgggtcgttacgctggcagtcgccgccttcatcttcaacaccaccgaatttgtccctgttggcctgctctctgacattgcgcaaagttttcacatgcaaaccgctcaggtcggcatcatgttgaccatttacgcatgggtagtagcgctaatgtcattgccttttatgttaatgaccagtcaggttgaacggcgcaaattactgatctgcctgtttgtggtgtttattgccagccacgtactgtcgtttttgtcgtggagctttaccgttctggtgatcagtcgcattggtgtggcttttgcacatgcgattttctggtcgattacggcgtctctggcgatccgtatggctccggccgggaagcgagcacaggcattgagtttaattgccaccggtacagcactggcgatggtcttaggtttacctctcgggcgcattgtgggccagtatttcggttggcgaatgaccttcttcgcgattggtattggggcgcttatcacccttttgtgcctgattaagttacttcccttactgcccagtgagcattccggttcactgaaaagcctcccgctattgttccgccgcccggcattgatgagcatttatttgttaactgtggtggttgtcaccgcccattacacggcatacagctatatcgagccttttgtacaaaacattgcgggattcagcgccaactttgccacggcattactgttattactcggtggtgcgggcattattggcagcgtgattttcggtaaactgggtaatcagtatgcgtctgcgttggtgagtacggcgattgcgctgttgctggtgtgcctggcattgctgttacctgcggcgaacagtgaaatacacctcggggtgctgagtattttctgggggatcgcgatgatgatcatcgggcttggtatgcaggttaaagtgctggcgctggcaccagatgctaccgacgtcgcgatggcgctattctccggcatatttaatattggaatcggggcgggtgcgttggtaggtaatcaggtgagtttgcactggtcaatgtcgatgattggttatgtgggcgcggtgcctgcttttgccgcgttaatttggtcaatcattatatttcgccgctggccagtgacactcgaagaacagacgcaatagttgaaaggcccattcgggccttttttaatggtacgttttaatgatttccaggatgccgttaataataaactgcacacccatacataccagcaggaatcccatcagacgggagatcgcttcaatgccacccttgcccaccagccgcataattgcgccggagctgcgtaggcttccccacaaaataaccgccaccaggaaaaagatcagcggcggcgcaaccatcagtacccaatcagcgaaggttgaactctgacgcactgtggacgccgagctaataatcatcgctatggttcccggaccggcagtacttggcattgccagcggcacaaaggcaatattggcactgggttcatcttccagctcttccgacttgcttttcgcctccggtgaatcaatcgctttctgttgcggaaagagcatccgaaaaccgataaacgcgacgattaagccgcctgcaattcgcagaccgggaatcgaaatgccaaatgtatccatcaccagttgcccggcgtaatacgccaccatcatgatggcaaatacgtacaccgaggccatcaacgactgacgattacgttcggcactgttcatgttgcctgccaggccaagaaataacgcgacagttgttaatgggttagctaacggcagcaacaccaccagccccaggccaattgctttaaacaaatctaacattggtggttgttatcctgtgtatctgggttatcagcgaaaagtataaggggtaaacaaggataaagtgtcactctttagctagccttgcatcgcattgaacaaaacttgaaccgatttagcaaaacgtggcatcggtcaattcattcatttgacttatacttgcctgggcaatattatcccctgcaactaattacttgccagggcaactaatgtgaaaagtaccagcgatctgttcaatgaaattattccattgggtcgcttaatccatatggttaatcagaagaaagatcgcctgcttaacgagtatctgtctccgctggatattaccgcggcacagtttaaggtgctctgctctatccgctgcgcggcgtgtattactccggttgaactgaaaaaggtattgtcggtcgacctgggagcactgacccgtatgctggatcgcctggtctgtaaaggctgggtggaaaggttgccgaacccgaatgacaagcgcggcgtactggtaaaacttaccaccggcggcgcggcaatatgtgaacaatgccatcaattagttggccaggacctgcaccaagaattaacaaaaaacctgacggcggacgaagtggcaacacttgagtatttgcttaagaaagtcctgccgtaaacaaaaaagaggtatgacgatgtccagacgcaatactgacgctattaccattcatagcattttggactggatcgaggacaacctggaatcgccactgtcactggagaaagtgtcagagcgttcgggttactccaaatggcacctgcaacggatgtttaaaaaagaaaccggtcattcattaggccaatacatccgcagccgtaagatgacggaaatcgcgcaaaagctgaaggaaagtaacgagccgatactctatctggcagaacgatatggcttcgagtcgcaacaaactctgacccgaaccttcaaaaattactttgatgttccgccgcataaataccggatgaccaatatgcagggcgaatcgcgctttttacatccattaaatcattacaacagctagttgaaaacgtgacaacgtcactgaggcaatcatgaaaccactttcatccgcaatagcagctgcgcttattctcttttccgcgcagggcgttgcggaacaaaccacgcagccagttgttacttcttgtgccaatgtcgtggttgttcccccatcgcaggaacacccaccgtttgatttaaatcacatgggtactggcagtgataagtcggatgcgctcggcgtgccctattataatcaacacgctatgtagtttgttctggccccgacatctcggggcttattaacttcccacctttaccgctttacgccaccgcaagccaaatacattgatatacagcccggtcataatgagcaccgcacctaaaaattgcagacccgttaagcgttcatccaacaatagtgccgcacttgccagtcctactacgggcaccagtaacgataacggtgcaacccgccaggtttcatagcgtcccagtaacgtcccccagatcccataaccaacaattgtcgccacaaacgccagatacatcagagacaagatggtggtcatatcgatagtaaccagactgtgaatcatggttgcggaaccatcgagaatcagcgaggcaacaaagaagggaatgattgggattaaagcgctccagattaccagcgacatcaccgccggacgcgttgagtgcgacatgatctttttattgaagatgttgccacacgcccaactaaatgctgccgccagggtcaacataaagccgagcatcgccacatgctgaccgttcagactatcttcgattaacaccagtacgccaaaaatcgctaaggcgatccccgccaattgtttgccatgcagtcgctccccgaaagtaaacgcgccaagcatgatagtaaaaaacgcctgtgcctgtaacaccagcgaagccagtccagcaggcataccgaagttaatggcacaaaaaagaaaagcaaactgcgcaaaactgatggttaatccataccccagcagcaaattcagtggtactttcggtcgtgcgacaaaaaagatagccggaaaagcgaccagcataaagcgcaaaccggccagcatcagcggtggcatgttatgaagccccactttgatgaccacaaaatttagcccccatacgaccactaccagtagcgccaacaccccatcttttcgcgacattctaccgcctctgaatttcatcttttgtaagcaatcaacttagctgaatttacttttctttaacagttgattcgttagtcgccggttacgacggcattaatgcgcaaataagtcgctatacttcggatttttgccatgctatttctttacatctctaaaacaaaacataacgaaacgcactgccggacagacaaatgaacttatccctacgacgctctaccagcgcccttcttgcctcgtcgttgttattaaccatcggacgcggcgctacgctgccatttatgaccatttacttgagtcgccagtacagcctgagtgtcgatctaatcggttatgcgatgacaattgcgctcactattggcgtcgtttttagcctcggttttggtatcctggcggataagttcgacaagaaacgctatatgttactggcaattaccgccttcgccagcggttttattgccattactttagtgaataacgtgacgctggttgtgctcttttttgccctcattaactgcgcctattctgtttttgctaccgtgctgaaagcctggtttgccgacaatctttcgtccaccagcaaaacgaaaatcttctcaatcaactacaccatgctaaacattggctggaccatcggtccgccgctcggcacgctgttggtaatgcagagcatcaatctgcccttctggctggcagctatctgttccgcgtttcccatgcttttcattcaaatttgggtaaagcgcagcgagaaaatcatcgccacggaaacaggcagtgtctggtcgccgaaagttttattacaagataaagcactgttgtggtttacctgctctggttttctggcttcttttgtaagcggcgcatttgcttcatgcatttcacaatatgtgatggtgattgctgatggggattttgccgaaaaggtggtcgcggttgttcttccggtgaatgctgccatggtggttacgttgcaatattccgtgggccgccgacttaacccggctaacatccgcgcgctgatgacagcaggcaccctctgtttcgtcatcggtctggtcggttttattttttccggcaacagcctgctattgtggggtatgtcagctgcggtatttactgtcggtgaaatcatttatgcgccgggcgagtatatgttgattgaccatattgcgccgccagaaatgaaagccagctatttttccgcccagtctttaggctggcttggtgccgcgattaacccattagtgagtggcgtagtgctaaccagcctgccgccttcctcgctgtttgtcatcttagcgttggtgatcattgctgcgtgggtgctgatgttaaaagggattcgagcaagaccgtgggggcagcccgcgctttgttgatttaagtcgaacacaataaagatttaattcagccttcgtttaggttacctctgctaatatctttctcattgagatgaaaattaaggtaagcgaggaaacacaccacaccataaacggaggcaaataatgctgggtaatatgaatgtttttatggccgtactgggaataattttattttctggttttctggccgcgtatttcagccacaaatgggatgactaatgaacggagataatccctcacctaaccggccccttgttacagttgtgtacaaggggcctgatttttatgacggcgaaaaaaaaccgccagtaaaccggcggtgaatgcttgcatggatagatttgtgttttgcttttacgctaacaggcattttcctgcactgataacgaatcgttgacacagtagcatcagttttctcaatgaatgttaaacggagcttaaactcggttaatcacattttgttcgtcaataaacatgcagcgatttcttccggtttgcttaccctcatacattgcccggtccgctcttccaatgaccacatccagaggctcttcaggaaatgcgcgactcacacctgctgtcacggtaatgttgatatgcccttcagaatgtgtgatggcatggttatcgactaactggcaaattctgacacctgcacgacatgcttcttcatcattagccgctttgacaataatgataaattcttcgcccccgtagcgataaaccgtttcgtaatcacgcgtccaactggctaagtaagttgccagggtgcgtaatactacatcgccgattaaatgcccgtaggtatcattaaccaatttaaatcggtcaatatccaacaacattaaataaagattcagaggctcagcgttgcgtaactgatgatcaaaggattcatcaagaacccgacgacccggcaatcccgtcaaaacatccatattgctacggatcgtcagcaaataaattttgtaatcggttaatgccgcagtaaaagaaagcaacccctcctgaaaggcgtcgaaatgcgcgtcctgccagtgattttcaacaatagccagcattaattcccgaccacagttatgcatatgttgatgggcagaatccattagccgaacgtaaggtaattcatcgttatcgagtggccccagatgatcaatccaccgaccaaactggcacagtccataagaatggttatccgttatttctggcttactggcatctctcgcgaccacgctgtgaaacatactcaccagccactggtagtgggcatcgatagccttattgagatttaacaagatggcatcaatttccgttgtcttcttgatcattgccactcctttttcacagttccttgtgcgcgctattctaacgagagaaaagcaaaattacgtcaatattttcatagaaatccgaagttatgagtcatctctgagataacattgtgatttaaaacaaaatcagcggataaaaaagtgtttaattctgtaaattacctctgcattatcgtaaataaaaggatgacaaatagcataacccaataccctaatggcccagtagttcaggccatcaggctaatttatttttatttctgcaaatgagtgacccgaacgacggccggcgcgcttttcttatccagactgccactaatgttgatcatctggtccggctgaacttctcgtccatcaaagacggccgcaggaataacgacattaatttcaccgctcttatcgcgaaaaacgtaacggtcctctcctttgtgagaaatcaaattaccgcgtagtgaaaccgaagcgccatcgtgcatggtttttgcgaaatcaacggtcattttttttgcatcatcggttccgcgatagccatcttctattgcatgaggcggcggtggcgctgcatcctgttttaaaccgccctggtcatctgccaacgcataaggcatgacaagaaaacttgctaatacaatggcctgaaatttcatactaactccttaattgcgtttggtttgacttattaagtctggttgctatttttataattgccaaataagaatattgccaattgttataaggcatttaaaatcagccaactagctgtcaaatatacagagaatttaactcactaaagttaagaagattgaaaagtcttaaacatattttcagaataatcggatttatatgtttgaaaattattatattggacgagcatacagaaaaagcaaatcacctttacatataaaagcgtggacaaaaaacagtgaacattaatagagataaaattgtacaacttgtagataccgatactattgaaaacctgacatccgcgttgagtcaaagacttatcgcggatcaattacgcttaactaccgccgaatcatgcaccggcggtaagttggctagcgccctgtgtgcagctgaagatacacccaaattttacggtgcaggctttgttactttcaccgatcaggcaaagatgaaaatcctcagcgtaagccagcaatctcttgaacgatattctgcggtgagtgagaaagtggcagcagaaatggcaaccggtgccatagagcgtgcggatgctgatgtcagtattgccattaccggctacggcggaccggagggcggtgaagatggtacgccagcgggtaccgtctggtttgcgtggcatattaaaggccagaactacactgcggttatgcattttgctggcgactgcgaaacggtattagctttagcggtgaggtttgccctcgcccagctgctgcaattactgctataaccaggctggcctggcgatatctcaggccagccattggtggtgtttatatgttcaagccacgatgttgcagcatcggcataatcttaggtgccttaccgcgccattgtcgatacaggcgttccagatcttcgctgttacctctggaaaggatcgcctcgcgaaaacgcagcccattttcacgcgttaatccgccctgctcaacaaaccactgataaccatcatcggccaacatttgcgtccacagataagcgtaataacctgcagcatatccgccaccaaaaatatgggcgaaataactgctgcgatagcgtggcggtatagcaggaagatccatattttccgccaccagcgcccgcaattcaaaatcatcgacatcctgcattgcttcgttttcttccaggcaatgccagcgcatatcgagaagtgcggcgctaagcagttcgctcatctcataccctttgttgaacaggctggcattacgcattttctgttgcagttcgtcaggcattgctgccccgctctgataatgccgggcgtagcgagcgaatacctgcggatgcgttgcccagtgttcgttgatttgcgacggaaattcgacaaaatcacgcggcgtgttggtgccggaaagcgtggcataacgctggcgggcaaaaaggccgtgcagcgtatgaccaaattcatggaataaggttatgacatcatcccagagtaacaacgcaggctcaccggcagcgggtttctgataattgcagacgttataaattaccggatgtgttttattaagcgttgattgctcaacaaaattgcccatccatgcaccgccgctttttgaatcacgggcgaagaaatcaccgtaaaataacgccagccccacgccattatgatcaaaaatttcccacacacgaacgtcaggatggtagacaggaatatcaaaacgttcgacaaacttaataccgaagagctgattcgcggtccagaatacaccttcatttaacaccgtgtttaattcaaaatatggcttgagctgcgcctcatcaagatcaaatttctcccgccgtacctgttccgcataaaatgcccagtcccacggctgcgcgctaaacccgccctgctgcttatcgataaccgcctgtatggaggctaattcatcgctcgcacgttgacgcgccgctggaacaatttcccgcataaagttaagtgctgcttcaggtgtttttgccatctgatcggcgattttccatgcggcataatgaggaaaaccaagtagtgttgcctgttgtgcacggatctccaccagacgttgaatgatagcgcgggtatcattggcatcatttttttccgctcgcgtccagcccgcaataaacagtttttcacgcgtcgcacgatcgcgcatttcggcaagcgccggttgttgggtggtattcagcagcggaatcagccatttgttatccagacctttctcgcgagccgcctctgccgccagcgcaatctcttgctcactcattcctgccagctgcgcgatatcgttcacaaccagaccgccggatttatttgctgccagtaatcgctggttaaactggctggtcagggtcgcagcttctgtattcagtacttttaattttgctttatcagcttgcgcaagtttggctccggcaaggacaaaacgttgatgaatcacctccaccaggcggatggattcactatcaagccccagggattcacggcgctgccagacagcatctacccgcgcgaataattcaccgttcagatagatatcattagccagttccgccagttcagcggaaaactgctcgtcaagacgctgtaattcatcattggtatgcgccgcagtcatcgcaaaaaagacgctggtaacgcgggtaagtaattctccgctttgttccagtgccagaatagtattgttgaaatcaggcatttgcgggttaagcgcgatggcagcaatttctgcccgcttttgctgcattccctcatcgaatgccgggcgatagtgatgattggcaatttgatcaaaatggggagccagatacggcagtgtgctttgcacaaggaaaggattcattgttgtcattttcttctcctgaacgcgaggtgttccatagcgtaggcttactgataacggagtgcaatcttgcaatccagtattacccgctcttaagcatcccgtgctatgttattgacacacaaaagcgttgaggaacagtgagatgatcgttttagtaactggagcaacggcaggttttggtgaatgcattactcgtcgttttattcaacaagggcataaagttatcgccactggccgtcgccaggaacggttgcaggagttaaaagacgaactgggagataatctgtatatcgcccaactggacgttcgcaaccgcgccgctattgaagagatgctggcatcgcttcctgccgagtggtgcaatattgatatcctggtaaataatgccggcctggcgttgggcatggagcctgcgcataaagccagcgttgaagactgggaaacgatgattgataccaacaacaaaggcctggtatatatgacgcgcgccgtcttaccgggtatggttgaacgtaatcatggtcatattattaacattggctcaacggcaggtagctggccgtatgccggtggtaacgtttacggtgcgacgaaagcgtttgttcgtcagtttagcctgaatctgcgtacggatctgcatggtacggcggtgcgcgtcaccgacatcgaaccgggtctggtgggtggtaccgagttttccaatgtccgctttaaaggcgatgacggtaaagcagaaaaaacctatcaaaataccgttgcattgacgccagaagatgtcagcgaagccgtctggtgggtgtcaacgctgcctgctcacgtcaatatcaataccctggaaatgatgccggttacccaaagctatgccggactgaatgtccaccgtcagtaatttttatacccggcgtaactgccgggttattgcttgtcacaaaaaagtggtagactcatgcagttaactcactcacaagcaagaacgaatgaccgtcgaaacgcaacttaatcccacacagcctgtcaatcagcagatttatcgtattcttcgtcgcgacattgtccattgcctgattgctccaggcacaccgttgtcggaaaaagaagtttctgttcgtttcaatgtgtcacgccagccggttcgtgaagcctttattaaactggcggaaaacggcctgattcaaattcgtccgcaacgtggcagctacgtcaacaaaatttccatggcccaggtgcgcaacggcagttttatccgtcaggccattgagtgcgcggtggcgcgtcgggcggcgagcatgattaccgaaagccagtgctatcaactggaacaaaatcttcaccagcaacgcattgccattgagcgcaagcaactggatgatttttttgaacttgatgacaacttccatcaactcctgacgcagattgccgactgtcaactggcgtgggataccattgagaacctgaaagcgaccgttgatcgcgtgcgctatatgagtttcgaccacgtttctccaccagaaatgctgttacgccagcatcttgatattttctctgccctgcaaaaacgtgatggcgatgcggtagaacgtgcaatgacgcaacatttgcaggaaatcagcgaatccgtgcgccagatccgccaggaaaacagcgactggtttagcgaagagtaattcatttcctctcatcccatccggggtgagagtcttttcccccgccttatggctcatgcatgcatcaaaaaagatgtgagcttgatcaaaaacaaaaaatatttcactcgacaggagtatttatattgcgcccgttacgtgggcttcgactgtaaatcagaaaggagaaaacacctatgacgacctacgatcgtaaccgtaacgcaatcaccactggcagccgtgttatggttagcggcaccggtcacactggcaagatcctgtcgattgatactgaaggtctgaccgctgagcaaatccgccgcggaaaaaccgtagttgttgaaggttgtgaagagaaactggcaccactggacctgattcgtctcggcatgaactaagcgtgtgaatgccgccgatggcggcattgcttttttacttcacggaatattttgccacggtcgctttcgcgccatgcgctaataaagacaagtacgtttccgtcactcttgcagtaaacaaactattgtctggcaaatcatcaccaaagatcgccttaatcgccagcaatgactggacgcgcgctttcccttcggcactactttgtacagccttctgaataacaggtaacagtgggtcactgatttctatcggatttccctgttcatcaacaccaccgacataacgcatccaacccgcgacgcccagcgccagcagatcgaacttgctgtcatgcgccagatgccagcgaacagaatccaacatccgctgtggcaatttctggctaccatccatcgcaatctgccaggttcgatgacgtaacgccgggttgctatagcgtgcaattaatcggttagcgtaatcttgcaaatcaacgccctgcactttcaacgtcggcgcttgttcctgcaacatcaagccatacgccgcataacgataatgttcatcttccatacagtcattaatgtgctgatatcctgcaagataccccagatacgccaggaatgaatgactgccgttgagcatgcgcaacttcatctcttcataaggcagcacatcgctaaccagttcggctcccgctttttcccattccggacgtccggcaacaaagttatcttctattacccactggcggaaaggttcacaggcaacgcccgcaggatcgcgcacaccggtaagttgttcgattttcgccagcgtatcctctgtcactgcgggcacaatacggtccaccattgttgatgggaaagtcacgttatcttcgatccattgtgccagttttacatcaacggcttgtgcgtaggaagtgacaacgtcacgcataacatgaccgttttctggcatgttgtcacatgacatgacggtaaatgcgggaagtcctgccgctttacggcgagccagcgcctcaacaatcacccctgttgctgttttcggctggtggggattttgcacgtcggcagctaccatcgggtgatcgagcattaactgtccggtcgccggagagtggaaataccctttttcggtgattgtcagagagacaatcgcgatttgcggttcacacatcgctgccaacacggtttctaagccatctatctgtacgtgcaaggcttttttaacgacgccaacgacgcgagccgtccacacatcggccgacatttccgcaacggtataaagattatcttgctgttgtaaatcggcaatttgctgttcgccgccgattaagttgacctcataatatccccagtcactgaaatgttccgtagcaagaatatcggcatacacaccctgatgcgcacggtgaaatgcaccaaagcctaaatgaacaattcttggagccaggttattaagatcataaacagggagtgtcgcttttgctgataacaaattatttcccataacaattccttaaatataaatatggcaagctatatgttttgttatatgaataaaaatcccctctccggtaagagaagggattaagggtttacagacttctggaaggttgcgcagctcttacaacacgcggttgatcttccgcagcgtcttccagcgcacttaaatcacggtctttcacctctggcattttcagcgcagagattaaaccaatcactgaatatgccatgatcataatggcgatcggataccaggattccgtcatggtgcagaaaatacccgccaggataggaccaaaaccggaagcgataagaccaccaatttctttagaaatagccatccgggtaaagcggtttttacagccgaacatttctgccatggtaatgttttccagagcaaataatcccagcaccgcacagttatgaatcacaatcagtgcaaccataatggtgctcggggcatagcttttatctacaatgatagaaagcattggccatgccagcacaatcgcggaggtattcataataatatacgggatccggcgaccaattttatcggataaccaaccaaggaacggaatggtcataaagccgagaatcgaactgatcatcaatgcatctgttggaattgctttgttaaacaataacgtctgcactaaatagcctgcaaggaaagtctgaattaacccggagttacccgcctgaccaaaacgcagccctgttgccagccagaaggatttgctctggaacatgctaccagcaggtgcaggttttgctgtcggttggttactgtcgttaaccttctcaaagaccgggctttctttcagattcatacgcaaccagatagcaaagaccatcacgacaacactcgccaggaacggtatacgccatccccacgccagcagttcctctttactgagaatgaagaacataaaggcccagattgccgttgcgctcaaggttccgcagttagttcccatagccacaaatgaggagataattccgcgcttaccttttggcgcatattccgccagcatcgtaccggcaccggaaatttccgcacctgcacccaacccctgaataatacgcaacgtcaccagcaagatgggtgcaaaaacaccaatctgtgcataggtcggtaacacaccaattaaggtggtacagatccccatcatggtgatggtaataaagagcacttttttacgccctattctgtcgcccattttgccgaaaataaatgctccgacaatacgcgccacataacctgcaccgtaggttcccattgccagaattaacgccattgccgttgatgattcaggaaaaaatatttcatgaaacactaacgctgcgccgagcgaatataactggaaatccataattcacaggtgttttttcccatcctgtggtttccttggcgttttctaggttttttcagatagttgcatttttttaaaaagcatcctaagttcgatctcagtgtctatctggggcctatttctgtcccatatatgccccaaaaaaactccccaacagataagtagttttttcatggatttatgcgtaaaatcaagaacggctggaaatcattcaatactcacactatcgaaaaatttaccagccaatcgcagcacgttcttgcataaggtgtgtctgcggtttttcaactattcagatacatcactcccatcacattcattcctccgcatcaaaggcatataggctatatcaccttgatatttttctttttcagataaaaactgttatctatgtatacttttaaacccaatccgtgtagagtctctacataagatagtttgcagttgccgcttcagcttgcgccataaaccgcctgatttttgctgccacctgttagcattcctgtatacctgaaacgacaatgtttatctacgaactttaagaacacccaagataaaaattgtcaactatatcatatataacacattactaattcgaggctatatgaacagcatactgataatcacatctctccttatcatattcagcatttttagtcatgccctaataaaattagggattggcatatccaataacccagacaaaaccgatgtataagtcaacatatcctgaatcagacatacaatatcgcaatgaaaatcaataatattttaaggaatatcttcatgaaatcaaaagacaccctaaagtggttccctgcgcagcttcctgaagtaagaattatcctaggggatgctgtagtggaagtagcaaaacagggaagacctatcaataccagaacattgcttgattacattgaaggaaacataaagaaaaaatcatggctggataacaaagaattattacaaacagcgatatcagttcttaaagacaaccaaaatttaaatggtaaaatgtaatataataaacttacttttttatcatttttccactttaacaacattttgctccacttttccacgaccaaacaacttgaaatctggttaaaataacacgcaacactattcttcttccttgagtccgcccggaactcgaaaaacaaaccgagttaaagccatttttcacaaaatcgattttgggtctcaccaaaattacggggttgcatacgcattcgtttattttcgaacgtgtacatacaaatatgcacaaaaataatcataattattttctgagatgcattatgatatgaacaccaatttcgtatagagtctcactatgtctcaaatttttgcttactgtcggatatcaacgctggatcagaccaccgaaaatcaacgccgggaaatcgaaagtgcaggttttaaaatcaaacctcagcaaataatcgaagaacacattagcggctcagcagcaaccagtgagcgtcctggttttaaccggttgcttgctcgcctgaaatgtggtgatcaattgattgtgacaaaactggatcgccttggttgtaatgcaatggatatcaggaaaacagtggaacaactgaccgaaacaggtatcagagtgcattgcttagcattggggggcattgacctgaccagtccaacaggaaaaatgatgatgcaagtaatttcagcagtcgctgaatttgaacgagaccttttacttgaacgcactcattccgggatagtaagagcccgcggcgcagggaaacgttttggtcgaccacctgtgttaaatgaagaacagaaacaggcggtattcgaacgaattaagtcaggtgtaagtataagtgccattgcccgggaattcaaaacctcgcggcaaaccattttaagagccaaagcaaaacttcagacacctgacatataaaaaataatctcggtgtgagatgctttacgtcttccaagcccccttccttgccgtaaatggaaagatacatctaattatagaatttatatgttttaccctacggcagtgctggccattcaatatcctgtgcagttgacgtatcaacacggttcagcaatacccgatactttttccatgcttccagcaacgagatttcttcctccgttgcaatttccagatctgcagcatcctgaagcggcgcaatatgctcactggctacctgcatcaggttgttttttgtttcttccgcctcccggatccggaacagtttttctgcttccgtatccttcacccaggctgtgccgttccacttctgaaactccccttccggcgataaccaggtaacattttccggtaacggaccgagttcagaaataaataacgcgtcgccggaagccacgtcataaaccgttttaccccgatgatcttcaacgagatgccacgatgactcatcactgttgaaaacagccacgaagccagccggaatatctggcggtgcaatatcggtactgtttgctggcagacctgtatgaggcggaatatatgcatcaccttcaccaataaattcattagttccggccagcagattataaatttttatggtccgtggttgttcactcattctgaatgccattatgcaagcctcacaatatagttaaatgcgatgtttttgacggtgttttccgcgttaccagcagcgttaacggtgatggtgtgtccatgtgaaccaatcgcaacggagtgcgtatgagcaccaataccgacagtatgtgcatgcgcgcctgcgcttgcagcagtgccggacagcgagtgggtatgagcaccatctgatgatgtcttccctgcattacgagtctggccactaccgcttgttgtgctcataatccccgcgcttagatttgaaatcgcggtataaccattagggaaaatgctcgtgttcgtgccaccaaatgcaccggaactcttgtgttggtgcgcaccggcactatttgcggtcccgctaatactatgggtatgcgccccggtgttattcgtggatttggttccgtaatcaaacgacgatgtggtttccgtccccaaatccgtactggatgcgctggcgctgtgggtgtgcgatttaatgccgtcctgttcctgagataatacggcccgaccactggcgggcttgcccttaatcgtccagccacgcatatcagggatcacgcctgacggataagcaactgcaagtttcgggtatgcagatttgtcaaaagtctgcccctgcatcagggcataaccagacggaacggtatctgatggccacgggattggtgcaccgactggataaaactctgcaggaggatgagccgaggtgtaaagctgcgcccacggcgaccagtttgcgtcggtcgtatcccgtcgtgaacgaataaatgccggagcatgagcaccgcttgtaccactccagccgatgagtaactcaccttcgccaacggctgtcatccctttcaggtgaatgatatttccatacgctgttggatatccgttgttatacacctcgtataactcaagacctgctgccccctgcgtattgtctgtcagcgcggttatattcactcagcaaccccggtatcagttcatccagcgcggctgctttgttcatggctttgatgatatcccgtttcaggaaatcaacatgtcggttttccagttccggaaaacgccgctgcaccgacagggggatcccgtcgagaatactggcaatttcacctgcgatccgcgacagcacgaaagtacagaatgcggtttccaccacttcagcggagtctctggcatttttcagctcctgtgcgtcggcctgcgcacgcgtaagtcgatggcgttcgtactcaatagtccctggctggagatctgtctcgctggcctgccgcagttcttcaacttcccggcgcagcttttcgttctcaatttcagcatccctttcggcataccatcttataacggcggcagagtcataaagcacctcattacccttgccaccgcctcgcagaacgggcattccctgttcctgccagttctgaatggtacggatactcgcaccgaaaatgtcagccagctgctttttgttgacttccattgttcattccacggccaaaaacagagaaaggaaacgacagaggcccaaaagctcgttttcagcacctgtcgtttcctttcttttcagggggtattttaaataaaaacattaagttacgacgaagaagaacggaaatgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtcaacgaagaacagaacccgcagaacaacaacccgcaacatccgctttcctaaccaaatgattgaacaaattaacatcgctcttgagcaaaaagggtccgggaatttctcagcctgggtcattgaagcctgccgccggagactgtgctcagaaaaaagagtttcttctgaagcaaacaaagaaaagagtgacattactgaattgctcagaaaacaggtcagaccagattgaagcaatttagataatcgtgcagactacgccccctcatatcacatggaaggtttatctatggatcaggtagtcatttttaaacaaatatttgataaagttcgaaacgatttaaactatcaatggttttattctgagctaaaacgtcacaatgtctcacattacatttactatttagccacagagaatgttcatattgtattaaaaaatgataatacagtgttattaaagggcctaaaaaacattgtgtctgtcaaattttcaaaggataggcatcttatagaaacgacctctaataagctgaaatccagagagatcacatttcaggaatacagaagaaaccttgctaaagcaggagtttttcggtgggttacaaatatccacgaacaaaaaagatattactatacctttgataattcattactatttactgaaagcatccagaaaactacacagatcttaccacgctaaaccataacgtccggcttctctcactcctgagccggactgcattggtttaataaaaaccatcaacaattgtgatttagatattcggaaccattcaaatataacaaaaccccgtaaaaacgaggtttatggataaattttattattgaatacatcagattaaattaatcttgacatcatagctttcaagacccgtcattttttcccgtgcggtaaactgaatactggtaacttctttcccggtctttttcttaagttcaataattttttttgttatatattcagaaatatctgcttctgcttttgtttttaagttttcaatattcatcatttcctcttttagtctgttatgactttccagttacacagtaagtcgattatatggtgcaaacgtgtaaaagataagatgaaacatcgcaataatcaacatacgatagtctaaattttacacaaacagacaaagagaattttcctgaattatcaatgcaatagcatcaaatcaactcaagagccttattgctgcttccagaatttcttctgaagtaacatgtcgatccgcggctacataaatgactttatgatctccggtcagagatggaaaccctgcggccattacagtaaggtgtgttttttcgccatttggatattcacgcatgatggtgttaactccagtcatcgctggcactaccactgctggttcagagttaaaaaaactatgatttttttcatgatgttaccgtagtatgtgagtatccatcgaatagacaccaagcaaaaaagctcccgaaggagccttcattttcacttttttaaatccaacgacagacggctggcatttaagtattgtgaaatattatcaaatgtaatcatcattgatttacaaaagatacattttgccccgaaaggattcatgtcagaaacatcaaaagatgatgttctatactgggaaccatgacaacacgggcatctaaagtgaatatggtttgtaatattgtctacctcaaagcgccactacatgaacagcggcaggacctttaggtccgttctcaataccaaattcaacttcctgattctcagttaatgttttgaaatcgttgctctgaattgctgagaaatggacaaacacatctttgctgccatctttcggcgtgatgaaaccaaaacctttttcagggttaaaccatttcactaaaccagtcattttgttagacataattattaccttttgaagaaattagcccttgggcagaatggtccgaaaaaaaatatcagagagaaaaaccaacaaggaaatctcaagaggtacaaataataaaattataacaatgactgcttcagataaatttgtaacaaaccagaacaccattaacgcatgattaaccacccatagcaaggattacttttgtaaagaaaaacacagcaatgaaagaatagctttatttattaataaaacgtgtcattctgattaagaccttttatcttacccttaagatttcaggaattttggctcatggaagagtcctttttatttaaattttacattccgcgatgtaaatgttccgatttaatattaccctacatttgatgctttttatctcttaaagattcatagatctgttgacaagtcactcctgcgatgtagcgttcgtcagcaatttcagcataaagctgagcttctgctgcaatatctccgagcatgttggtgagcattccttcggcggttttggttgttttgcctctgacggcagcggcaagatctgcggtatgcttcgctgcgtcaaggcgtatggcatatttttttgcttcggcacgcaactggttaacactatcagacagataagcagccctggcagaaatttcagcagatttctgttgcgcatctttaacagcctcatcacgggctatagttcgcccctgttcaattattcgagcagcaaattgagcatttacctcttgtgataatgcggcagcatcacgttccgcccattttttttgccatcctcggtcgctccagacatttccgacgataaatcctgacaacacgagaaaaatcaccatgaatatctgattcactgttctatcccccagcaggttaatgcgctctcctggtcacgacgaataacctgaccgtaacagttatttgaacgaatgcggcaatcgcgtccgccatccttaatccaccagcgaatcgcttcgcatgcacctttacgatcaccagcattcagccgcttataaaacgtcgacgggaaacacttaccggggccaatgttatagggacaaaatgacgcgatacccgctttttgtggttcggtcagtggtactttaatattgcgctccacccatgccagcgccttatcacgctcaatggcgttgacctggtcgcatttttccttcgacagtttcatattgggaaaaacggtttttccatccaccactgtggcaccccgacagatggtccatatgccagaaccatcgcggtatgccattgtgtggttaccttctttttcgtccagaaactggtcaagtatctgaggagcagatgcgccagcaccaatcagcgccagaacggcagccgacaggccgtatctgatttttgtgttcatagatatttatgatgaggacgctcgtgcttattggcaggattttcaatcttaaaggagtactgatgctgcagataagactcaactttttctgacaatttttctgctacttccaggaagacttgccggacgctccttctggctgctgcctcataaaactccagcgcagctccttcaacacggtccatggcgacatccaggtcaaaaatttcaccgtcaaagcgttctttgtcctgtaaggctacagttaccgtaactttattctcaaaattacggactcctttcacaaccagttcatagtcttgagtcattggattactctcctctcgcagccttacgcctgtcttctttaatcttgaaataaagatttgtcagatacgtcagcaggccaaaaaccaggctacccagcacaccgattgcagcccactgtgacggagttactttatcgagtaactgcaatgcccagaaaccagcattacccgccgatgtgccataggcaacacctgttgttaacttatccattgatttcatatcctcaccccgatgtacacggatggtgcaatatgtttgaaaagatcggagtctacggggtagttttgacagcacacgttgttctcaacggcgctaaaaaaacatacacattaaaaatgtgggtaattattttgaaagaaagtcatatataaaataataatacgagaaatgttttcatatttagtgtactgtatacggccatttatacaggaaaagcctatgtcagaacgtaaaaactcaaaatcacgccgtaattatctcgttaaatgttcctgcccaaactgcacccaagagtcagaacacagtttttcaagagtacaaaaaggtgcccttttgatctgccctcattgcaacaaagtattccagacaaatcttaaagctgtagcctgattgattttattagtaacaagtattttttatattttaataatatatttaaagcagataataaaaaacccgcctgagcgggtttgagattgtggtgctttttgtgggagtcatccacttacgcactttgttttgccatgccagcagttagcttctgctgtaaaactattcatgcagcaaacctgcacttcaccacaatggttagcatacttttcctgattaagattttgccaaatatgctagccattgtttcatgtattggacctccttactttttattaaagagatccaatattcactactctgtccgtatctctactcaggcatcagccttcttcgttatcgtatacagacgagcgatgaattttaatcagtaatgatgacatttgctgctgcaggacctttagcaccactctctatagagaaggtaaccttttgaccttcaaataaggttcgataattatcattctgaatcgcagaaaaatgcacaaacacatctttactaccatcaacaggagaaataaagccgaaacctttatcagcgttaaaccattttactaaaccagtcattttatttgacattctacattccttaacttgagcctttcggcataaatggtttgcataacagaaacgacttcgtacttaattggagagactcaaagaaggaataagtgaataacacctgaaatgagaactgctttagtaaactacttcgtatatcgtctgttcttcaaaccgacgcaatcattaacgcatagttgaacatatgaagcaatgtttattttagacatccagccatcttcaaccccatcaaaaaactatagctttcttcaggaacgtgtgtatagtgcgccaagttatcagtattaaggaatttttttgtcccgtaaaatgacaggaattgtcaaaacctttgacggcaaaagcggcaagggtcttatcaccccatccgatggtcgtatcgatgtccagcttcatgtttcagcgctcaatctccgcgatgcagaagaaattaccaccggattacgcgtggaattttgccggataaatggtctgcgtggcccttcagctgccaatgtttacctttcatgagctatattaaagctttaatttcaggccccatcggatcacacatggagagtttttatgaataaccccgtctgtcttgatgactggttgattggctttaaaagcttatgctgtactttggccgtaatagctctgctaataatataataagcagactcattgtgtttagggacattgtactggaagaaaacattttaaacatcaggcaaataaccaagtcaccagctaaataataagttaacagacatgagtcccgggatgagattcaacattaccattgccccatttaaagcacaaaacccgctcatcagcgggttttctactttttcttaacgtcgggtatacaaagcccatcgttgaaaaaattttatccatattttttgaaaaatgcaaacatcatgtcgccatcttcagcaaaaatcatttatctcgtcaccttcctcaattgcgcttccgcgtatgcttcttcctgccagcactttgttaccagtttaccaatgacgtccgcataccccttataccactgataatcggtcaggtctggtaccagcttctggacatgacgtcgtgccagcgtggtcggtaaacgactaaaccggtttccattacaacgcccacaaatcttatataccggtacgccatgaaaccgggttcttttttcatccagaacaatccctttacccttacaccctctgcacgctgtgctggcttcgcccttaccatggcaatgctgacatagttccttcacccattcttccttgattacagattccccgcgtctgtagtgtttcaccacttcgcgcaatacattataaaatcccgtacctgaacaatgctcacagcgagccttacttgccgcagacctggagtaatcagcaaaggcaaaactcacgaggtaaggaataatctgtaaccggatttcttcactcaatttgttcaatgtcgggttatccagtgccatcgcgtaatttagcaggccttcaatcgcaaactgagggtcctgaacaccaacttttgccagaaataaggccaacccaagtggtgctttcgactgcaccatcccctgcgctgccattacatccgtaattgttaaacaaccggtgcctgtcgctggagcgtcatcgctcaattttggagattttggggagtaatattttggtaaggcttcaaggttcatgctcgttctccacttacgccagtacgccaattgccagcgcgcgatcgataaaacgaaatatcagctccagttgggagccatacttatcttcaaatgccactgtatccgtatgcagctcgttgtgatgctttctgcacaaaggcaacacaaagagatcatgtgcttttgttcccattccgccctgcccgtgaccaatcagatgatgcggatcgtcggctggcataccgcagcaagcacacggctgtgtcttaacccaacgtgtgtatttctccttaacccagcggcgacgtttaggcagcttcatgaaagattccggagactctggatcaacggtgatgcttaccaccgtcttttcctgtggtgatttttgttgctggtgggcgtaaggcaacggtgcaagattttttgtgcgttgtttcaatatgctggtggcggtcagctctcccggtacgatgtcgctttcgcggtacaccgagcagattttttccgctggtaatcccagcgaacgacgcgatacagcctcaggtagtgcatccaccacctgattgcagaccgcccaccaggataattcagccaaagataattcccgctcctgcgtaccgcttattgcgtgacggatgacgtcaatcacccatgctgtcagattttgttgagcaagcagctccagtgattccgatgtctggtcacgcagttggttgtcgcagtgccagcacaacaccattgcgccggtaccataacggtgaatgactgtttcagtgtgatggtaatcgccattaggccactggcaggatgtaacatgacgtaatagccagtcggacaatgcgccaacgccgccagcagcacgaatcacccgttcgttactaaaaaacggcagcaatgttttgtcttccgccagcggctggcgaacggcaggaacgactccggatggcagattacgcatgctttttggttccggttccaccagcactcgaggattatgaaatatctgtatggattcacggcccggcttaaggaccaccagcccaagctcaggcaccagaacaggtctaagtaatacccgcacgttacctccagatccgttgctggaaagtgcgggacgcacgtggtgggcgttcggaataaggcagcctgacagagattatccagtgccgatagtcgagactgagagctttcttaacctcgaacccgcgcctgcggtaagaatgaatcagccattcggcctgttctgcagtgcatggagggtgctggaaccattcagacttgaatgcgtgagaataccgcccgtgcgtgcaggcaagaacgggcgaattatcagaattgtaatattttgcgttgcgtgccatcggttttctccggtggcacggtgttactcagcgggagttcagccccgcgcaagattgtagatgagtttattctcctgaaaaagcagaaaagccagcttttattccgatctctttcaatgcctgtaatgaagtgacaaactcaccttcgcgcaagataaatccgtccgtgacccgagcatccacaaaattaattaacgcagccccattctttcgcaaacacataatgcggtaatgactaacaagatttccattttcaacgcacacagcatagaggccatcttcacaaaaaattttacgcagttcttcgatgttcatcatcagaatccttccggataattagctctcccctttaagggaccatccctcttatccctgcgcgctacttaagtatttttgattctattccggcaccgtccagaacttcaaacgcgttgaaaataaaaacaaaaacccgccgaagcgggttaagtgcgggtgcgttgaggatgcctgccacatcagaggtggcgagggatttctcccccgccgggtctcttactcctcaggttcgtaagctgtgaagacagcgacctccgtctggccggttcggattcgtacctcgcagaggtctttcctcgttaccagtgccgtcactatgacggttaaacagatgacgatcagggcgattaacatcgccttttgctgcttcatagcctgcttctcctgtcaacgcaaagcagaagtgtcaccttcggtgcgaaacagagatgtcatgctttggttcagagaatgcgtttgaccgcctcgctatatacttccgagcgttctcttttcccaacagaaatcacgaaaacgacaactttctcgtctataacctggtatacaaggcgatagcctgaagaccggagcttaatcttgtaacaatcaggcataccacggagcttgtttgcttcaatccggggtgactcaagtacttcaaccagcttctttttcaactgttcacgtaccgtcgagcccagctttcgccattcctttagtgcccgctcgtcaaaatccagaaaatacgccatcagagttcatccagcgtcacacgtactggcttaggattacgaagccgttctttcactatctccacaagttcagcatcttcatcactcaggagtgtctgtttgaacggcaagcgttcattgtcagcgatatactcgagcatgagacgaagcgcttcagaaggagttacacccattttttcaagcgcggcgtaagaacgcgctttaagttcatcgtcaatacgcaggttaatgctacccatgtcttacacctcttgtaattacaaatgtcattacaagtatcgcactacaacatgcttagggcaagtcacgaaggaagtcagaaagtagtcgtaagaacggtgatcactgtccgctttgtgccaggagcagccattgctaagtccatcctgtattgtgcaggtcagctcgtttttaaagagtccggccatcatcttactggtacagacaccatatactttgtgacggtcaggctacatatgcacaactcaacttattcatctattttttgctttagcatgtcagtgttgctttctcgtcggcgggtgagcggtgacctgacctgtcgataaaggaacgtaacacgttttatgcaacacccgcatgcggcagaaaattattgccgaacgtttacccctgtcaacaagctttactttctgaggcgcgccagcccgcgaggaaaacaatctgaacatcaaacaattaatgacacaagaaatacgattaaagatttttttgtgcatgccgatagtgcttttttaaaaggagaaatctatgtctgtcacaattcagggaaatacctcaaccgttatttcaaacaactccgccccggaaggaacatcagaaatagccaaaatcacaagacaaattcaggtgctgactgaaaagcttgggaaaatctcatcggaagaggggatgacgacacagcagaaaaaagaaatggctgcattggtacagaagcaaattgaaagcctctgggctcaactggagcagttgttaaggcagcaggcagagaaaaagaatgaagacgcgacagttcagcctgataaaaaagaagagaaaaaagacgatacaaataccgctggcaccattgatatttacgtctaagtgacagccgtattgtggccctcatcgggccacttttcgccatcagccttttctttaaagacatattatctttgtatcatttctgatagttaacattacaagatataagtaatggacgcactcccaattagtctatttaaatcgccacgagtttaactgacaacccatgatcaattatgaattgcaactatttctgtagtcacttttgtggggacagtccacaaaactgccaacttccgcttcttgctcttagcggacattagcataggctatttaccataacgcctcattacgcgcaccgcccagactgactcagcgcgtttctggcatatccccggtaaaacaagtaacaaaccacccgaaaatgaacaccagaaacgcgacttaagaatctaccctatgaatggatatgcactcaaccgaatcgatcttggtttcaatcttttttatcgggatcaggcttctttttaggtaacttcgggggcttaacttgctgatgactttgcgttcggcgcgtaagccagggatggtcagctttaggtttaacatagtattttgagcgtaaatcaatacgggcattatccactcgttcatggacactcttttcatcatccagtggtagcctccataattgcaggcactagcgccgtgaacttttcacgcttatccctggtgtcgatagccttccagcgttcaaatatcttcactcgattaacgccaagcgctcgctgatcaatcgcgccaccttcatatgtgacacgctgaacatcgatgttcgggcgctctttcaaagcccagaatgcttcagtgattaatatcgtcgcctgctcctgtgtcattcctggtcgacatatccaggcatccagagcctcacgagcctgttcaggagtgattttcattgttcaaccgccccgcccgcttcgtcttacgatattcatcataaactttgggatcatactgaagctccccgccagatgcctcctgtagacgcatcgcgcgaccttcgggaactaaatcccctttccagctataaagcgaagccaaacgaatacctgctgcttgtgcaagttttgtttttgaaccgaaatacaaaagagcgtcagttttaagcatttaaaacacctttattgttagtcataactaacaagatagatgttaacaaaaacatagtcaatacgatttagcattagctaactatggaaacaaaaaatttaactatcggcgaacgcatcaggtatcgtcggaaaaacctcaaacacacccaaaggtctcttgctaaagccctgaaaatctcccatgtgtctgtatcacaatgggaacggggtgatagtgaacctacagggaagaacctttttgccctcagtaaagtattgcaatgctcaccaacatggattctatttggcgatgaagacaagcaaccaacaccacctgttgagaagccagttgccttatcccccaaagaactagagctccttgagctgtttaatgcactgccagaatcagaacaggatacccagctcgccgaaatgcgagctcgagtaaaaaacttcaataaactctttgaagaattactaaaagcccgtcagcggacaaataaaagataacatcatcaatgagttatcttttaccacatcaattatgttagctatagcatacaaaatcacttgaccgatatgttagtcatggctaatcttgtttgcatcaacacaccgcacggtgttctcagcaaacagttccgctaccccagcgttaaggggaaatgaggtcagcatggatactatcgatcttggcaacaacgaatctctggtgtacggcgtgtttccaaaccaggacggcacgttcaccgcaatgacgtataccaaaagcaaaacgtttaaaaccgaaaatggtgcccgtcgctggctggaaagaaactcaggtgagtgatatggatttcgacacaatcatggaaaaggcttacgaagaatacttcgaaggccttgccgaaggcgaagaagctctcagcttcagtgagtttaaacaggcgctttccagttcggcaaaatctaacggctgataagcgaaacagcaccgcgaggaatcagtatgcagaaacgagaacccgtcatcatcgcgccagactataccgatgatgaactttatgagtggatgcgccagaaaattaatgcagcgcaggatctgaaatgggctaatgaagccagggctaagcaggctgaaaatctgtccgctctggagcaggatatcaccaatctggaaaaagcagcggcattaagcattgccagaatgattacatacccgcgttagtagctaatcaacaaagctaaggttagtaattaaggagttctccacgggtgaggtggagtgcgtgcgccggacacgggtgcgcatccggaactgacagtttactgaaaggatatttccctgaaaagtcagaccataacgcgaaagcgcatggcgaggtagctggttcatagatagcctgtcgttaaattttcgtcgaccgtgcgcttccggttgtggcaacccgcgaaatggcgcggcggtaagtatggcggggttattccttccccgttgaggacaccgggttgtcaggttgaccatacgcttaagtgacaaccccgctgcaacgccctctgttatcaattttctggtgacgtttggcggtatcagttttactccgtgactgctctgccgccctttttaaagtgaattttgtgatgtggtgaatgcggctgagcgcacgcggaacagttaaaaccaaaaacagtgttatgggtggattctctgtatccggcgttaattgttaactggttaacgtcacctggaggcaccaggcactgcatcacaaaattcattgttgaggacgcgataatgaaaacgttattaccaaacgttaatacgtctgaaggttgttttgaaattggtgtcactatcagtaacccagtatttactgaagatgccattaacaagagaaaacaagaacgggagctattaaataaaatatgcattgtttcaatgctggctcgtttacgtctgatgccaaaaggatgtgcacaatgaattcagcatttgtgcttgttctgacagtttttcttgtttccggagagccagttgatattgcagtcagtgttcacaggacaatgcaggagtgtatgactgcagcaaccgaacagaaaattcccggtaactgttacccggtcgataaagttattcaccaggataatatcgaaatcccggcaggtctttaaaacagttccgtaataaatatccggtttcattcttatatgccagcaatggcagggatttgttcatccttaaatctgtcatgaggttaaaacaaatgagtaaagtctttatttgcgccgctattcctgacgaactggcaacaagggaagaaggcgctgtggctgtagccacagccattgaagctggcgacgaacgccgtgctcgagcaaaatttcactggcaattcctggaacattatccggctgctcaggactgcgcttataaatttattgtctgcgaggataaacctggcataccccgccctgccctcgattcatgggatgctgaatatatgcaggaaaaccgctgggatgaggagtctgcttcttttgtcccggttgagactgaatccgatccgatgaacgtcacttttgacaagctggcccctgaagtacagaacgctgtcatggttaagttcgacacatgtgaaaacatcaccgttgatatggttattagcgcacaggaattgttgcaggaagacatggcaacattcgacggacatatcgttgaagcgttgatgaaaatgccagaagttaacgccatgtatccggagcttaagttgcacgccattgggtgggttaagcataaatgtattcctggtgctaaatggcccgaaattcaggcagagatgcgcatctggaaaaaacgtcgcgaaggtgaacgcaaggaaaccggaaaatacacgtctgttgttgatctcgcccgcgccagagccaatcaacagtacactgaaaattcaacaggaaaaatcagcccggtcattgctgccattcatcgcgaatacaagcagacatggaaaacactggatgacgaactggcctatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccacaggtgaactacgctcctctgtttgttacgcaataaaaactggtgttttcgactatgcaaaacagtttccctcctcacgcaatctggaaaaatttggtgaggcccgacaagatttaaccataaaagaactggctgaaaaatttctggcactgaaagaaactgaagtcgccaaaacatcactcaacacataccgtgccgtcatcaaaaatatcctgagcataatcggtgaaaaaaatcttgcctcatcgattaataaagaaaaattactggaggttcgtaaagagttactgactggataccagatccccaaaagtaactatattgttacacaaccagggagatcggctgtaactgtaaataattacatgacaaatcttaacgccgtgttccagtttggtgttgataacggttacctggcagataatccgtttaaggggatctcgccattaaaggaatcaagaaccattccggatcctctttcgcgggaagaatttatccgtcttatcgatgcgtgcagaaatcagcaagcaaaaaatttatggtgtgtttctgtttatactggagttcgccctggtgagctgtgtgcacttggatgggaggacatagatctgaaaaatggaacaatgatgatcaggagaaatttagcaaaagaccgtttcacggtaccaaaaacacaggcgggaaccaatcgggtcattcatcttattaagccagcaatcgacgctctccggagtcagatgacattaacgagactgagcaaagagcatatcattgatgttcacttcagagagtatggcagaacagaaaaacaaaaatgcacctttgtttttcaacctgaagtgtcagcgagagtaaaaaattatggtgaccattttaccgttgactcaataaggcagatgtgggacgcagcgataaaacgtgccggactccgccatcgaaaatcatatcagtcgagacatacttatgcctgctggtcgctgacagctggtgctaacccggcatttatagcaaaccagatgggccatgcagatgcgcaaatggtatttcaggtatacggaaaatggatgtctgaaaacaataatgcacaggtagctttgttaaatacacagttaagcgagtttgccccaaccatgccccataacgaagcaatgaaaaattaatttaatatttatcaaatagttaacacgcatgactcttgaaatccataaattcaagcgcagtgcccagccatcccgatactgctgctttcaccaaatccttagtgcttctttcgtgtttttctattgtcataatggttatctctaaaaaagaggtaagatgcgtactacttactcgccgttattggtattattcagaaaaagtgagtaagactttgcagcaatgtttttgatcctgttcaaataaactaatggcatcagcaacatgctggaaatcaaacgtatgggtaattaatttttctggtttaattaaccctttacttaaccagtcgataacgatcgggaatttatttgcatttaagcgtgaagagaaaatagagagttcttttccggtaattccttgctgaatcacttcagacggttcactggagaaccccatcaatacaatacgtgccgctggagaagccagcgttacggcctctttcaggatagaaggatgacaagccgcatcgataattaatgtcggcttgatgcctttttcagtgaaaatctcgccaagcggtgtctggctgttattaatcgcccagtcagccccgctctctttcgctttttccagtcgttcatcaatgcgatcggcaacaatcacatttttaacgttatagacgccttttaatacctgaacgatcgtcaggccgattggaccggcaccataaaccagaacggtatcattttcagtcggttgaccatgtccggttacgttagccgcaatggtaaaaggttcgatcattaccgcatattgatcggccactgcttcaggaattttccacgcattttttgccggaaccacggcatattcactgaaaccaccgtcagcgtgcacacctaatacagccagtgtcgtacaaacgttcggtttacctatagagcacggatagcaatgcccacagctgaccaccggatcgacagcaacacgttcaccgactctggcgctttccacgccttcacccactgcatcaatgacgccaaagaattcatgaccaatgacgcgcggatatttcgcaaaaggattatgcccacgataaatatggctatctgaaccacaaattccggcaagtttcacttttactcgtacttcacccgctgacggggtgggtatttcacgttcgacaatcgccagttgattcggtttttcaattaatatgcttttcattatcttactccttaccagttccacagcgtgccatcttccagacgtgcgactggtagataagcaggttcatagggatatttcgccgccagcttttcatcgaattcgataccaagacccggtttgtctcccggatgcatatagccgttatcgaaagtccagttgtgcgggaagacttcgagcatttgttcggaataacccatgtattcctggacaccgaaattggggacccacagatcaaagtgcagcgccgcagccatgcagactggtgacaaatcggaaggaccgtgtgagccagtacgtacctgatacagcgaagcaaaatcggcaatccggcgcataccggtaattccgcctgcatgggtcagcgtggtgcggatataatcgatgagttgctcttcaatcagttgtttgcagtcccagatgctgttgaagacttcacccactgcgatgggtgtgacggtatgttggcgaatgagacggaagcattcctggttttccgcaggcgtcgggtcttccatccagaacatgcgataatcttcaatgcttttaccaaagcgcgccgcttcaataggcgttaagcgatggtgcatgtcatgcagcaaatgttcattaaaaccaaacttgttacgtaccgcgtcaaacaatttcggcatgaaatcgaggtatttctccgtcgaccacagctgctcttccggccactgtcctttggttgcgggttcataagccagacctttacctttcgacatgccgtaggtggttttcataccagggattccgcactgcacgcggatggctttgaatccaagctcttgatgacgggcataatcatccagagcttcatcaatactgtgaccggtggtatggcaataaaccatcaccccttcacgagacgcgccgccgagtaactggtaaagcggcatgttggcagctttggctttaatatcccacagcgccatatcaaccgctgaaatggccgacatcgtaaccggaccgcgacgccagtaagcacctttatagaaaaactgccagatatcttcgatacggtgcgcatcgcgaccaataagctgcggacaaaggtgatcctgcaaataagaggccacggaaagctcacgtccattgagggtggcatccccaaggcccgtaataccgtcctcagtggtgatttttaatgtgacgaaattacgccccggacaggtaacaaaaacttcagcctttacgatcttcatgttcgattccttgcatcgcttgtcgtgatgcatgaaatctacgcaactgagctactaccatacaagtataaagatcgaaaaaagccggagtgatcacaaaaaaaggcgtatatttgcgctgtgaatggttgacaaaagatgaaatagaataccttttgtcagctgacacttcctcttatcttattgataaaatggatttatgttcctacgtgcgcccccagcccgcaacaatgatcaacatgccgcaaagcgcaatcaacgcacccgtccagtcataaagagtcagtttcacgccatccacaacgcgcagccacatcaacgccgtgcagacataaacgccaccataagccgcgtaaacacgcccactcgccgctggatgcaacgttaacaaccagacaaacagcgccagtgaaatccccgccggaagcaacagccagatactggcgtttcgttttaaccacaaccagggcagaaagcatccaataatttcacacagcgcagtagcaaaaaatagtaacgttgttttaatcatctttgtctcttattgacatcatgtatagttatagggcgacataatatcatcaatataaacaccctcctggtacgttttgcgtccgcagtggatggtgtagaatcacctttaatcattcatacagggaatgaattatgaaaatcactctcagcaaacgaatcggcctgctcgctattctgctgccttgcgcactggcattgagcacaactgttcatgccgaaactaacaaactggtgattgagtctggcgacagtgcacaaagccgccagcacgccgctatggaaaaagagcaatggaatgacacgcgcaatctgcgccagaaagtgaataaacgcactgaaaaagagtgggataaagccgacgccgcttttgataaccgcgataaatgtgagcaaagcgccaacatcaatgcctactgggagcccaatactttgcgctgcctggaccgtcgaactggccgcgttattaccccctaacctgttattgatttaaggaatgtaaggacacgttatgccaagcgcccacagtgttaagctacgcccgctggagcgtgaagatttacgctatgtacatcaactcgacaataacgccagtgtgatgcgttactggtttgaggaaccctacgaagcctttgttgaactctctgatctgtatgataagcatattcacgatcagagcgaacggcgctttgtggtggaatgtgacggcgaaaaagccggtctggtggagctggtggaaattaaccatgttcatcgccgcgcagaatttcagataattatctccccggagtatcaggggaaaggtctggcaacccgtgccgccaaattagcaatggactatggctttaccgttctcaatctctataagctgtatctgatcgttgataaagagaatgaaaaagcgattcacatttaccgcaagcttggcttttcggttgaaggtgaattgatgcacgagttctttattaatggtcaatatcgtaatgccattcgcatgtgtatattccagcatcagtatctggcagagcacaaaacaccgggtcagactctcctgaagccgaccgcacaatagcattaataataatcgatcgtatttttgatggtgtaaacccgttcgacggcgggttttactccttcatcaacaatgattagctgacagtccaccggattagcgtgactgtcatattcacagctctgttttacattaccaacccgttgattattcagtaaagtaaccgctgtgtaatctaattttttgatcggatccgttgatggcgtggcgctgacagataatgttttgtcgttacttttcgtggttttacccagcggataaccctgatcatcatagcgatattccatctgcatttgtttgctgctggctttaatcacgaagccattatcatcggtttcccaactcaccccggcagaaggtaattctgctagctggcattttccctgtaaacgtactctcttctccagcgtctcggcatcacggtaataattggcgtccagtaccagagcgaccacggtattattttccagatccagtaattcgagtgaatcaaaacagccttcttccgacaaagtcccagaaacacgtttcgtcacttcaccttgctcatccattaatgtctgagtgaaatcttttaccggaccacgcagcggatcaaaatcgaattcattagagaaactggccatctcaggggtaaatgaaagtgttacctctgtgcggtcacatcctgtgaggaatatcgcgagtaagcatggtagtaatttgtatttcacaacagtcaccagagagtagagatgattctcaatcatagtagcaaatacagtactttacacgttaaatgctatgcttaaagaagttatcttcgcgtaaggagcttatgatgaaactctcaacctgctgtgccgcgcttctgctcgccctcgcctcacccgcggtactcgccgcgccgggatcctgtgagcgcatacagagcgatatatcacagcgcattatcaataatggcgtacccgaaagcagcttcacgttaagtattgtacccaatgaccaggttgatcagcctgattcccaggtcgtcggccattgcgctaatgatacgcataaaattctctatacccgcaccaccagcggtaacgtctctgctcccgcgcagtctagccaggatggcgcgcctgccgaaccgcagtaacacattatcgactgaacgccggatatgacaaatccggcgatttgaacatacaacataatcccaccttattactcatacccttctattgatatggattaataattcttaacccaaaatgggtagactccctctattgttagcgcgctaaatattcaatatataaacttttatataacgataaagaacagggagtgagttatgtccaaaaatgaacgaatggtgggcatcagccgcagaacactcgttaaatctaccgcgataggttctctggcgctggctgcaggcggtttttctttgccgtttaccctgcgcaatgcagcagcagcggtacaacaggcccgcgaaaaagtggtctggggtgcctgttccgtcaactgtggtagccgctgtgcacttcgtctacatgttaaagataatgaagtgacctgggtggaaactgacaataccggcagcgatgagtacggcaaccatcaggtacgcgcctgtttgcgcggtcgctccatccgccggcgtattaatcatcccgatcgcttgaattacccaatgaaacgcgtgggcaaacgcggcgaaggcaaattcgaacggattagctgggatgaagccctggatactatcgccagtagcctgaagaaaaccgtcgaacaatatggcaatgaggctgtatatattcagtactcttcggggatcgttggcggcaatatgacccgctcttcgccatcagcctcggcggtcaaacgcctgatgaactgctacggcggttcactcaaccagtatggctcctacagcactgcgcaaatttcctgtgccatgccctacacctacggcagtaatgatggcaacagcaccacggatattgaaaacagcaagctggtcgtgatgtttggtaacaacccggcagaaacccgcatgagcggtggtggcatcacttatcttcttgaaaaagcgcgcgagaaatcgaacgccaaaatgattgttatcgatccgcgatataccgatacggctgccggtcgtgaagacgaatggctccctattcgcccgggcaccgatgccgcgctggttgcgggtattgcctgggtattgattaacgaaaatctcgttgatcaaccttttctcgataaatactgcgtcggctatgacgaaaaaaccttacccgcagatgcacccaaaaatggtcactataaagcctatattcttggtgaaggtgacgataaaacagcgaaaacgccgcagtgggcttcgcaaattaccggtatcccggaggaccgtatcatcaaactggcgcgtgaaattggcacagcaaaacccgcttatatctgccagggctgggggccacaacgccaggcaaacggcgaactgactgcacgcgctattgctatgttacctattttgacgggcaatgtcggcatcagcggcggaaatagtggcgcgcgtgaatcgacctataccattaccatagaacgcctgccggtgctggataatccggtcaaaacgtcaatctcctgcttcagctggacagatgctatcgatcatggtccgcaaatgacggcaatccgcgacggcgtccgcggcaaagataaactggatgtgcccattaagttcatctggaactacgcgggaaataccctcgttaatcagcattctgacatcaacaaaacgcatgaaattctgcaggacgaatcgaaatgcgaaatgattgtggtcatcgaaaactttatgacctcatcggcaaaatatgccgacattctgctgccagacctgatgaccgttgagcaggaagatattattcctaacgactacgccggtaacatgggatatctcattttcctccagcctgtcaccagcgaaaaattcgaacgcaaaccgatttactggatcctgagtgaagtcgcgaaacgtcttggacctgacgtctatcaaaagttcacagaaggtcgcacgcaggaacaatggttacaacatctgtacgccaaaatgcttgccaaagatccggcgttaccgtcttacgacgaactgaaaaaaatgggtatctataagcgtaaagatcccaatggccattttgtcgcctacaaagcatttcgtgacgaccccgaggcaaatccacttaaaacgccttccggtaagattgaaatttattccagcaggctggcggaaattgcccgtacctgggaactggaaaaagatgaagtgataagcccattgccagtttatgcctcaacctttgaaggctggaactcccctgaacgtagaaccttcccactgcaactgtttggtttccattacaaatcccgtactcactcgacctacggcaatattgatctcctgaaggctgcctgccgtcaggaggtgtggatcaaccctatagatgcgcagaaacgtgggattgccaacggcgatatggtgcgggtgtttaaccatcgtggcgaagttcggctaccagccaaagtaacaccacgtattctccctggagttagcgctatgggccagggagcctggcacgaggccaatatgtctggcgataaaatcgaccatggcggctgtgtgaatacgctaaccactctgcgcccttcaccactggcgaagggaaacccgcagcacactaatctggtcgagatcgaaaaaatataacccacgacaaccataaattctggcatgacattttgtttgaaaagcaataagtgagtaatgatgaaaatccataccacagaggcgctcatgaaggctgaaatcagccgtagaagtctgatgaaaacctccgcacttggcagtcttgcgctggcaagcagtgctttcactctgccattttcccaaatggtccgggcggcagaggctccggtagaagagaaagcggtctggagttcctgcaccgttaactgcgggagccgctgtctgttacgtttgcatgtgaaagatgacaccgtgtactgggtggagtctgatacgacaggtgacgacgtctacggtaatcatcaggttcgagcgtgtttacgcgggcgctctatccgccgacggatgaatcatcctgataggttgaaatatcccatgaagcgcgtcggcaagcgcggtgaaggtaaatttgaacggataagttgggacgaagccctggataccatcagtgataatcttcggcggatcctgaaagattacggcaatgaggctgtacatgtcctgtacggaacaggcgtagatggcggaaacatcaccaactcaaacgtcccgtaccgtctgatgaactcttgcggtggttttctcagtcgctatggcagctacagtaccgcacagatcagtgccgcaatgagttatatgttcggtgccaatgatggcaacagcccggatgatatcgccaatacgaaactggtcgttatgttcggaaataacccggcagaaacgcggatgagcggcggtggtgtcacttactacgtcgagcaagcccgcgaacgttcaaacgcacgcatgatcgtcatcgatccacgttataacgacactgctgccgggcgtgaagatgaatggctgcccattcgccctggcaccgatggcgcactggcctgtgcgattgcctgggtactgattactgaaaacatggtcgatcagccatttctcgacaaatattgtgttggttacgatgaaaaaacgctgcccgccaacgcaccacgtaacgcgcattataaagcctatattctgggcgaagggcctgacggcatagctaaaacgccggaatgggcagcaaaaatcaccagcatcccggcagaaaaaattatccagttggcacgagagatcggttcagcaaaacctgcttatatttgtcagggttgggggccacaacgacattccaacggcgagcaaacatcccgcgctattgccatgctttccgttctcaccggcaacgtcggcataaacggcggcaactcaggcgtacgcgaaggtagctgggatctgggggtagaatggttcccgatgctcgagaatcctgttaaaacgcagatttccgtctttacatggacagatgccatcgaccatggtacggaaatgaccgcgacccgtgatggtgttcgtggaaaagaaaaactggatgtccccatcaagtttttatggtgctacgccagtaacacattgatcaatcaacatggcgacatcaatcacacccatgaggtgcttcaggatgacagcaagtgcgagatgattgttggcattgaccacttcatgacggcctcggctaagtattgcgatatcctgttgcccgacctgatgccaacagagcaagaagaccttatctctcatgaatctgcagggaatatgggctatgtgatcctcgcccaacccgcaacctcagcaaaatttgaacgcaaacccatctactggatgctgagtgaagtcgccaaacgcttaggaccagacgtttatcaaacctttactgaaggtcgcagtcagcatgaatggatcaaatatctccatgcgaaaacgaaggaacgtaaccctgagatgcccgactacgaggagatgaaaacgaccgggatctttaagaaaaaatgcccggaagaacactacgtcgctttccgcgcattccgtgaagatccacaggcaaacccgttgaaaacaccttcggggaaaatcgaaatttattctgaacgactggcgaagattgcagatacctgggaattgaaaaaagatgaaattattcatccccttcctgcgtataccccaggttttgatggctgggacgatcccctgcggaaaacctatccactgcagttaacgggcttccattacaaagcgcgtacccactccagctacggcaatattgatgtgttacagcaggcctgcccacaagaggtgtggatcaaccccattgatgctcaggcacgcggtatccgtcatggcgataccgtgcgggtatttaacaataatggagaaatgctgattgccgcaaaagtgactccgcgtattctgcctggcgttaccgccatcgggcaaggtgcgtggcttaaagcggatatgtttggtgaccgggtcgatcacggcggcagtatcaatattctgacctctcaccgcccttcaccgctggcaaagggaaacccgtcgcacagcaatcttgtccagatcgaaaaggtttaaggagtagcccatgaccacacaatatggattttttatcgattccagccgctgtactggctgtaaaacctgcgaactggcgtgcaaagattttaaagatcttggcccggaagtcagtttccgccgtatttatgaatacgctggcggcgactggcaggaagataatggcgtctggcaccagaacgtgttcgcttattatctctccatctcctgtaaccattgcgatgaccccgcatgtacaaaagtctgccccagcggcgcaatgcataagcgtgaagatggctttgtggtggttgatgaagatgtttgtatcggctgccgctactgccacatggcttgtccgtacggcgcgccacagtacaatgctgaaaaagggcacatgacgaagtgcgatggttgttattcgcgcgtcgccgaggggaaacaacccatatgtgtcgaatcctgcccgctgcgtgcacttgagttcggtccaattgaagagctgcgccagaagcacggcactcttgctgccgtcgcgccactgccgcgcgcgcatttcacaaaacccaatatcgttatcaaacctaacgccaacagccgcccgaccggcgataccactggttatctggctaatccggaggaagtgtaaaatgggaaatggatggcatgagtggccactggttatctttaccgtattgggtcaatgcgtagtaggcgcgctgattgttagcggaattggctggttcgccgccaaaaatgacgcagaccgtcagcgtattgtccgtggcatgtttttcctctggctgttgatgggcgtcgggtttattgcctctgtcatgcacctgggatcgccactgcgggcgtttaactccctgaatcgaatcggagcttctggtctgagtaacgagattgctgccggttccatattttttgccgttggcggattatggtggctggtggcagtcatcggtaaaatgccgcaagcgttggggaaactctggttacttttcagcatggcgctcggcgtcattttcgtctggatgatgacctgcgtgtatcaaatcgacaccgtgccaacctggcataacggttacactacgctggctttcttcctgacggtattgttgagcggtccaatacttgctgccgcaattctgcgggcagctcgcgttacatttaataccacaccatttgccatcattagcgttctggcgctgatcgcttgtgccggggtgattgtgctgcaaggtttgtctctggcgtctattcactcatccgtgcaacaagccagcgcactggtaccagattacgcctccttacaggtctggcgtgtggtattgttatgcgcaggtcttggatgctggctttgcccgctcattcgtcgccgtgaacctcacgttgccggacttattctggggctaatcctcatacttggcggtgagatgatcgggcgtgtgctcttttatggcctgcacatgacagtaggaatggctattgcaggttaacaaattggtgcggggcaacccgcacatttcaggatgttaggaatgacccatttttcacagcaagataatttttctgtcgcggcgcgcgtgttgggcgcgctgttttattacgctccagagagtgcggaagccgcacctctggttgcggtactcaccagtgacggctgggaaactcagtggcctctaccagaagcgtcattagcgccgctggtgacggcttttcagacacagtgtgaagagactcacgcccaggcctggcagcgtttgtttgtcggcccgtgggcactgccgtctccgccgtgggggtcggtctggctggatcgcgaatctgtgctgtttggcgattcaacattggcacttcgtcagtggatgcgcgagaaaggcattcagtttgaaatgaagcaaaacgaaccggaagatcattttggttcactgctgttgatggctgcgtggttggcggagaatggtcgccagacagaatgcgaagaattgctggcatggcacctttttccgtggtcaacacgttttcttgatgtttttatcgaaaaagcagaacaccctttctaccgtgcactgggtgaactggctcgcttaacgctggcgcaatggcaatcacaactgttaattcctgtcgcggttaaaccgctgtttcgataggatcaccgtaatattgccggatggtgacgattacgcgcaatccggcaataataggttacagtgtcacgtttttttatctcttaaagcacgcactgcttttgcggctggcctcttttgccgcaaaatagtcgcccgtgtttcattgcccatttctgctcatgcatcatctacacatctatccggatctgcgcactatgttccaccgtctgcttatcgcaacagtcgtcggtattctcgcggcctttgccgttgccgggtttcgtcatgcgatgctgctactggagtggttgttcctcaataatgactccggcagtctggtcaatgcagcgacaaacctttccccctggcgacggttgctaactccggcgctcggcggactggcggcgggtttgttgctgatgggctggcagaaatttacccaacaacgccctcatgcgccgaccgattatatggaagcgttgcaaaccgatggacagttcgattacgcagcaagcctggttaaatcgcttgcctctctgctggtagtaaccagcggcagtgcaattggtcgcgaaggtgcgatgattcttttagctgcccttgccgcctcctgttttgcccaacgttttacgccacgccaggagtggaaattatggatcgcctgtggggccgcggcgggaatggctgcggcctatcgtgccccgcttgctggcagtttatttatagccgaagtgctgtttggcactatgatgttggcctctctcggcccggtgattatttccgccgtcgtggcattgctggttagcaatctgattaatcatagcgacgcgttactctacaacgtacaactctcagtgacggttcaggctcgtgactatgcgctgattatcagtacaggtgtgctggcaggtctgtgcggaccactgttgttaacgttaatgaacgcctgtcatcgtggatttgtgagtctcaaacttgcgccgccctggcaactggcactaggcgggttgatcgtgggtctgctttccctgttcacacctgcagtgtggggcaacggctatagcaccgtacaatcctttttaaccgccccaccactgttaatgatcattgccgggatcttcctttgtaaactgtgtgccgtgctggcgagtagcggttccggcgcacccggtggggtctttacaccgacgctatttatcggtcttgccattggcatgttgtatggtcgtagcctgggattatggttccctgatggcgaagaaattacacttttactcggattgaccgggatggcgacactgttggcggcgaccacgcacgcgccgattatgtcgacgttgatgatatgtgaaatgaccggggagtatcagctactccccggtttattgattgcctgcgtaattgcgtcggtaatttcgcggacgttacaccgtgactctatctaccgccagcacactgcgcagcatagctaagcggatgtattgccccagttcacgctgttcggcgcgcggcagataaggcagttcaccaatgagcggtgccggaagttttttacccagcacatcaatgatttccgcataatgcgccagtcctgggttgattcggttagccacccagccaatgagcggcagcccgtcgttggcgatcgcctgagctgttagcagtgcatggttaatgcaaccttcctgaataccgacaaccatcaacaccggcagttgttcctgcactacccattcagagagtggacgcaaatcattcatcagactgcgccagccgccagtcccttctaccacgacatgatcgactttttcggtcaggtttgccaggccgtttgaaatgagggtgtaattgattgggcaactgtgcgccacgctactttcttcttcgcttaacgcgataggattaactgcttcataaggcagttcgatggttgaaacactctgcaacaccagggcatctttattacgcagcccttcgggtgtctctttgctccccttcgctacgggtttatatcccgcaaccgtttttccctgggaggctaacgcttgtagcaatgcgcgggaaaccaccgttttccctacagaagtgtctgtaccggtaataaagaaacgcttcagcatcactaactccaccgttatgcttcacaaatataaaccaggaaaataattaaccttgaaagtctaagttatgctttcctggcccaaattgagatagcgcaaattttggtagaacagttaaaaaatgttaaccctgcaacagacgaatcaacaaagaaccgttatacatcgcgtcttttaccagtgcagcgcctgccatcgtgccctggttagaaaactgagtactctcaacgctgatgtgctgactatacgcaggaagggcctgctgacggatgctgtctgagatgaccgggaagaggatatctgccgctttacttaacggtgagccaatcagtattttttgtgggttaaataaattcaccatgatggcaagaatgcgcccgacatgcgcgcccaccccggtaatgatgtcttttgccagtagatcgccgcgcaatgccgcctgacacaatgagtccacggttaacggttgtccatgtaacatcgagctcatggattgattaagacgcagctgtgccagctcaagaatactgtccacgctggcgatggtttcgaggcagccgtgattcccgcaataacagcgtttcccatacgggtcgacctgtgtgtggcctatttccacgagactactgctgcctgcgtgtagcagatgaccatcggtaatgacgcccgcccccacgttgtgatcgataaccacctgaatcacatcgcgcgccccgcgtgaggcaccaaacaaggcctctgccatcgtccatgcgctgatatcatgctgaatataaaccggaacgccggtatgctgctccagcgcctcgccgagcggcatctcttttacatcctcgtagaacggcatgcgatgtacaataccattttccgtatcaataattcccggcaaggttatggcaatcgaagttagacgctcaagttttttctggtggcggataaaaaactgatcgatatgggaaataatacgatccagcaatggcaagtcatcttttaacgccagttcctgcgactcttccaccaccagtttgctgctcagatcgcgcagagcaaggaaaatctccccgcgactaatgcgcagagaaagatagtgccaggcttcagtttcaaccaccagccccaccgccggacggccacggttccccgcttctttgatttccagctcttgcaccaggtgtgcttcgagcatctcacggacaattttagtgatactggcaggagccagttgcgccagacgggaaagatcgatacgcgagactggaccaagctgatcaatcaggcgataaaccgcgcccgcgttggtctgctttatttgatcaatgtgcccaggctggttttcagcaaccaccgcatactccctatattttcgcgctccgaaataatctgtaggctatggtgaagcacttcaatacgtgtcgtcaaatttttacttaggcatgtgattaacagcacatttttcgggctttttcgctgaaatttccctcacctgagagcattcagcagatgaatacgaaagttacgcgcagccggactttgttcatgatgtttcggccagaccaaccacatttcagaaaccgcatcctcttcagcaatcggcacccagcgcatttcgttgagctgaacacgtttaaatgacgcaggcaaaattgaaacacccagaccggcggaaaccagaccgatgatggtcattgcctcgcccacctcctgagtgatgacgggcgtcaaatggtaacgtcgcatcagcccgagaatatcgtcatacagccctgtcccgacgtgcggatcaaaaaagacaaagggttctttcgccagttcagccagcgttacattcgggttatttgccaggggatgatcgtgcgggatcatcgccataagcggttcatggacgatgactgcgtgttcaagcgactccggtaacgctgtgttacgcagcaatcccatatccagcgttccttcaatgagcggagcgatttgctcgcgagtgttcatttcgcgggtttgtaaatggacatcaggataatcacggcgaaacagcgataacgtatcggacaccgcccgaataaaaggagccgacgaagtaaaaccaatgcgcaactcccccgcttcaccctgatgcagcctttcagcgcgagcggcagcgtcatccaccatagacaggatttgccgactatctgcaagaaactgttttcctgctgccgtcagcaatacactgcgattggttcgtgccagcagtcgggcaccaatttgttgctccagcgcctgaatctgctgacttagcggcggttgcgaaatattcaggcgggcagcggcgcgcccgaaatgcagctcttccgcaacagcaacaaagtaacgcagatgacgaagttcaatattcatatttaaaacatcttatttgagattattaatatattagacagaacaattcgattttcctaccctatgtataagcctgatctacaggcatatttagcaaggatttcaagtgagccgtactacaactgttgatggcgctccggcaagcgacactgacaagcaaagcatttctcagccaaatcaatttattaaacgcggtacgccgcaatttatgcgcgtcaccctggcgctgttctctgccggactggcaacatttgcacttctctattgtgtgcagcctatccttccggtgctttcgcaggagtttggcttaacccccgcgaacagtagtatttcactgtccatttccacggcgatgttggctattggtttgctgtttactggcccgctatccgatgccattggtcgcaaaccagtgatggtcacggcgctactgttggcctccatttgtacgttactttcgacaatgatgaccagctggcacggcattttgattatgcgcgccttgattgggctttcgttaagtggcgtggcagctgttggcatgacttatcttagcgaggaaatccatcccagtttcgtggccttttcaatggggttgtatatcagcggcaactcaattggcggcatgagcggacgcttaattagcggtgtcttcacggactttttcaactggcgaattgctctggcggcaatcggttgtttcgcgctggcctcggcgttgatgttctggaaaatcctccctgaatcacgccattttcgcccgacttcgctgcgccctaagacgttgtttatcaactttcgtctgcactggcgtgaccggggattaccgttattgttcgcagaaggctttttgctgatggggtcgttcgtcacgctgtttaattacatcggctatcggttgatgctctccccctggcatgtcagtcaggccgtggttggcttattatcgctggcttatttgaccggtacatggagctcacccaaagccggaaccatgaccacccgctatgggcgtggtccagtgatgttgttttcgacgggggttatgctgtttggtttactgatgaccttattcagctcgctgtggctgatctttgccggaatgttactcttctcagcaggattcttcgcagcccactcagtagccagcagctggatcggcccccgcgcaaaacgcgctaaaggccaggcctcctcgctgtatctgttcagttactatctggggtcgagtattgccgggacgctgggtggtgttttctggcataactatggctggaacggcgtcggcgcatttattgctctgatgctggtcattgctctgctggtcgggacgcgtttgcatcgtcgtctgcacgcctgaaaaataagtccggactgcggtaaatacccgtccggacttattgccagctcaaaccaacgttaatagccatcctaaaatagacgaagcgccagccaattcccgcagcgcgtctagcgtcatcaggattataagtacccaaataaacggattcattttgctgtgtgtcatttattactgatgcgcagttattctactgctttgtaagtagtaaaatagttaacccgatcaagactactattattggtagctaaatttcccttaagtcacaatacgttattatcaacgctgtaatttattcagcgtttgtacatatcgttacacgctgaaaccaaccactcacggaagtctgccattcccagggatatagttatttcaacggccccgcagtggggttaaatgaaaaaacaaattgagggtatgacaatgaaaaaagtattagctctggttgttgccgctgctatgggtctgtcttctgccgcctttgctgcagagactacgaccacacctgctccgactgcgacgaccaccaaagcagcgccggcgaaaactacacatcataaaaaacagcataaagcagcacctgcccagaaagcgcaggcggctaaaaagcatcataaaaatacgaaagctgaacagaaagcccctgaacaaaaagcgcaggcagcgaagaaacacgccaagaaacacagccatcagcaaccggcaaaacctgctgcacaacccgcagcgtaagttttcaacagtaatgctggcgcgccccctcgcgcctgaaaattacggtgctaagcgggtaacgtttagcaccgcctttagcggagggtagtatggtgggccgttatcgctttgagttcattctgatcatccttattttatgcgcactgattaccgcccgtttttatctttcctgattgtagttatctgattttactcccactttcatcccgtcccgtctatagtatttatgagggtttgcttttaataatcataattacccaccagagtgtgatatgcgtacaaccattgctgtagtgttgggtgcaattagtttgacgtctgcttttgtgtttgcagataaaccagacgttgccagatcggcaaacgatgaggtcagcaccctgttttttggtcatgatgatcgtgtgccagtgaatgacacgacccaatcaccgtgggatgcggttgggcaactggaaacggccagcggcaatttatgtacggcgacgctgattgcacccaatctggcattaacggcaggacactgtttattgacacctccaaagggtaaagccgataaagcagtggcgctgcgttttgtgtcaaataaaggtctttggcgctatgagatccacgacatagaaggccgcgttgatccgacactgggaaagcggttaaaagcagatggggatggttggattgtacctcccgcagccgcgccgtgggacttcggattgattgtgctacgtaatcccccttctggcattacgccgttgccgttatttgagggagataaagccgcgcttaccgccgcattaaaagcggcaggtcgtaaagtgactcaggcaggctaccctgaagatcatctcgatacgttgtacagtcatcaaaactgtgaagtgactggctgggcgcaaacgtcggtgatgtcacatcagtgcgataccttgccgggtgacagcggttcgcctctgatgttgcataccgatgacggctggcaattaattggggtgcaaagttcggctcctgccgcgaaagatcgctggcgcgccgataaccgggccatttctgttaccggttttcgcgacaagctggatcaactgtcgcaaaaataatgttcaaacgctgcccgacagcgcgggcagcgtcttcatcaggcaagtttcaccatgatcattccagccaacagcaagaccaggccaatccagcctttacgatttaaccgttgaccaaacaagatccaacctgcggctaacgtggcggcaataccaaacccgccccacaatgcataagcgacagacaagtcgatccctttaacggcttgagaaagcgcactaaaggcagccagcaccgccgccagggagagcaagccaaatattttgcgacgaaagccgtcagaaaatttcaaaaagacgttagcaacgatttccagcacgattgccaatgccagccaggcggcgtgaacccattcaaactgcgccatggttcacctccagttcaggtttacgcgctttacgggtacctgattttatcaacacaatcccggcgaccagggtggttaacccggcaattttcatcagcgataaactttcgtcgaataacaaaacgctaaacaaggtaataaataaaataccgataccttcccacagcgcataagctacgcctaaggcgatttttttaacggcgaaagagagaaatatatacgacagagaaatcatcaccagcattaaaataaagccgccatttccctcactgacgctcgcccatttcattgacagcgtaccggtaatttctgtagcaatagccagacctaataaaatccaataaatatacattgtccttctcctgcaagagaattattttaattttcgcttaattcagcgaaaccaaagtaaagtggtcaagccccgcgcatagcgcaagctttggcagaagaaaggactaaagcgcgttgcgccagtgctgctcacctacgagcaagatagtggatgaggtacgaagatgggtaaatgtagaaaataacgtcctgaacaaattgtccataatattacaattatccgcagtgttgcttctcgtcatcgcggatgataattgtcctcggtagttgaacacgcctgatttgtatcatagcttaagaattaactcaaaatattttcacttctttacctgagcggtttgattttcgttatgatgacggagcgaaaaagacattattattagcaaaggaagaaaaaacggggacaagcatggcaaagccgatcatcacgctcaatggcctaaaaatcgtcattatgttgggaatgctggtcattattctctgcggtatccgttttgccgccgagatcatcgtgccgtttattctcgcattatttattgctgttattcttaacccgctggtgcaacacatggtccgctggcgtgtgccgcgtgtactggcggtgtcgattttgatgaccatcatcgtgatggcgatggtgttgctattagcttatctgggttccgcgctcaacgagttgacgcggacgttaccgcaatatcgcaactctattatgacgccgctgcaagcgcttgaaccgttgttgcaacgcgtagggattgacgtctcagttgaccagctggcgcattatattgatccgaacgcggcgatgacgttgctcaccaacttattgacgcagttatctaatgccatgtcatcaatatttttattgctgctgacggtgctgtttatgctgctcgaagtgccacaattgcccggaaaatttcagcaaatgatggcgcgtccggttgaagggatggcggcgattcaacgtgcgattgacagtgtttctcattatctggtgctgaaaacagccatcagcatcatcaccggcctggtcgcctgggcgatgctcgccgcactcgatgttcgcttcgcttttgtctggggattgctggcctttgcgcttaattacatcccgaatattggttcagtcctcgcggcaatcccccctatcgctcaggtactggtgtttaatggcttctacgaagcgttgctggtgctggcgggatatctgctgattaatctggtcttcggcaatattctggagccgcgtatcatggggcgtgggctggggctttccacattggtggtatttttgtcgttgattttttggggatggttgttaggaccggtgggtatgctgctttccgtgccgttgacaattattgtcaaaattgcgcttgaacaaacagcgggaggtcaaagcatcgccgttctgttaagcgatctcaataaagagtgacggcctcagcagaggccgtcagggttacagagctttcaggattgcatccacgctggctttggcgtcaccaaacagcatgtgggtgttttccttgaagaacagcgggttttgcacaccagcatagccagtgttcatcgaacgtttaaagacaatcacgttctgcgctttccacacttccagcacaggcataccagcaatcggactcttcggatcatcctgcgccgccgggttaaccgtatcgttagcaccaatcaccagtacggtatcggtatcagcaaagtcatcattgatctcgtccatttccagcacgatgtcatacggtacttttgcttcagccagcaatacgttcatatgtccaggcaaacgccccgcgaccgggtggataccgaaacgcacattaataccacgagcgcgcaatttctcagtaatttcagcgacaggatattgcgcctgcgcgactgccatgccgtaccccggagtaatgatcactgaatgggagtttttcagcagttccgctgtctcttctgcggtgatttcgcggtgctcacccacttcctgatcatcgccagtagaagagccgtcggtgccgaaaccacccgcaataacgctgataaaggaacggttcatcgccttacacataatgtaagaaaggatagcccccgaagaaccgaccagcgcaccggtcacaatcagcaggtcgttgctgagcataaagcccgcagccgcagccgcccagccggagtacgagttcagcatcgacaccaccactggcatatctgcaccaccgatggaggcgactaaatgccagccgaataccagcgcaattgcggtcattatcagcaatgccagcacttgcaggccgacgctgtccgtgcgaacaaatacaatcagcagcaggaaggaaacgaccagagccgccaggttcattttgtgacggtttggcagcatcaatggtttagacgaaatcttgccacacagtttgccgaacgccaccaccgaacccgtgaacgttaccgccccgatgaagataccgaggaacacttccgtcaggtgaatattgaccagaatcggtgccattcccgcgtcatgatgcagatagctgttaaagccaaccagcactgccgccagacccacgaagctatgcaggatcgccaccagttctggcatttcggtcatttcaactttcttcgccagacggataccaattgccccaccaatgaccatcgccagcaagatccagccaacattacccgtatccggtccaaaaatggttgcgattaacgcaatcgccatcccggcgataccgaagttgttaccctggcgagacgtttcatgtttcgaaagaccggccagactgaagataaacaggatcgcggcaacaatgtatgcagctgtaactaatcctccagacatatgttaccccttaatttttgcggaacattttcagcatgcgctgagtcacggtgaagccaccgaaaatattaatgctggctataagcaccgcgataaaactaaggaagctaacccagccgccctggccaatctgcaacagtgctccgacaacaataatccctgaaatcgcgttggtgaccgacatcaacggtgtatgcagcgcgtgcgatacattccacaccacgtaataaccgacaacgcaggccagcgcgaaaacggtgaagtgcccaaggaattctttcggcgcaacgcttgccatccagccaaaaagaatgattgccagcgccatcaacgcgtatttacgccacggtgagcaggtacatttttcctcagttttcacttccggtgccgctttttgtgccgcctgcggctgagctgatacctgaatcggcggtgccggccaggtaatttcgcccgcacggatcacggtcacgccgcgaatcaccacatcatcaaaatcaacagtgatattgccgtctttctctttgcacaacagtttcagcagattaacgaggtttgtgccgtaaagctgtgaggattgcgtcggcagacggcccggaagatcggtataaccaatcactttgacaccattttccgtagtgaagatttcacccggcacggtgtattcacagttgccgccgttttgggctgccaggtcgacaatcacactgcccgccttcatggagtcaaccatttcacgggtaattagcttcggcgctggtttgcctggaataagcgcggtggtgacaatgatatcgacctcttttgcctgggcggcaaagagttccatttccgctttgatgaacgcgtccgacatcactttggcatagccatcgccgctgccagcttcctctttaaaatccagctcgaggaattccgcgcccatactttgaacttgttctttcacttccgggcgggtgtcgaatgcacgcacaatcgcgccgagactgtttgctgcgccaatggcggccagacctgcaacacccgcaccaatcaccatcacttttgccggtggcactttcccggccgcagtaatttgcccggtaaagaagcgcccaaattcatgtgccgcttcaacaatggcgcgataaccggcgatgttcgccatcgagcttagtgcgtccagcgattgtgcgcgtgagatacgcggcacagagtccatcgccatcacggtcacgttacgttccgcaagtttttgcattaattccggattctgcgcaggccagataaaactcaccagcgttgtcccaggattcagtaacgcaatttcatcatctaacggcgcattgaccttcagaatgatctctgactgccagacgctattcccttctacaatttcagcgcccgcttgcacaaacgctttatcgtcaaaacttgccagttgacccgcgccgctctctaccgcgacggtaaaacccagtttcagcagctgttccactgtttttggcgttgctgcaacacgggtttcattggttaaccgttctcttggtatgccaattcgcatgatattcccttccatcggttttattgatgatggtttgcctgtgtcaggagccacacaagctgctcatgtacgagctaaatgttactccgttaaaataaattagtaacaaacgccctataacgtactgaaaattatgcctgtgatctagcgccaaaaatcagtatttcggcgtgaactcgcaaaatattaacgattcagccgtgatagtgggataaacaccttagaacgccggataaagactgataattgtcttcgacggtcgggtaaaacgagacatcgccccggcacgaatcactacttaacattaaattaacttatacaattcagttgcttcagtagtaatgatgctgatacggctgttttttaagcatagacggtcatttgagcaggattaaaattggcttaaggaatgtgatatgaaaaatgacgcagacagttacaccgtttaaatgcaataatcagccacgtttctcgttaataacaataccagtacctggtttgcgcaaggcgaaggattatttttatgaagcttaagaacaccctcctggcgtcggcactgctttctgctatggcattctccgttaacgcagcaacagaactgacaccggagcaagcggcagcggttaaaccttttgaccgtgtagtggttaccggtcgttttaatgctattggcgaagcggtgaaagccgtttctcgtcgcgcagataaagaaggtgccgcctctttttatgttgtcgacacttctgattttggtaacagcggtaactggcgtgtggtcgctgacctctataaagccgatgctgaaaaagcagaagaaacaagtaatcgcgtaattaacggtgttgtcgaactgccgaaagatcaggctgttctgattgaaccgtttgacacggtcaccgtccagggcttctatcgtagccagccagaagtcaatgatgccatcaccaaagcggcaaaagcgaaaggtgcctactctttctacatcgttcgtcaaatcgatgccaaccagggcggcaaccagcgtattactgcattcatctataaaaaagatgctaagaaacgtatcgtccagagcccggatgtgatcccggcagattccgaagcaggacgtgcagctctggctgccggtggcgaagccgcgaagaaagttgagatcccgggtgttgcgactaccgcatcaccaagttctgaagtcggtcgcttctttgaaacccagtcatcaaaaggcgggcgttacaccgtcacgctcccggatggcactaaagtcgaagaactgaacaaagcgaccgcagcgatgatggtcccgttcgacagcatcaaattctctggcaactacggcaacatgaccgaagtctcctatcaggttgcgaaacgtgccgcgaagaaaggtgctaagtattaccacatcacccgccagtggcaggaacgtggtaataacctgaccgtcagcgcagatctgtataaataactattcagttactcctataaggcggcttgatgccgcctttcgcatttttagtcacaaatttccccgcgaccattgcatgcagacacatctcttcgtaaaatcccgcgcttcagtggcaaactccatttttatgcgttttgccctaatatttattcttcttatcacgttttaatcactggatatcgatggaaaagaaactgggactgagcgcactcaccgcgctggtattaagctcaatgctgggcgcgggtgttttcagtctgccgcaaaatatggcggcagttgccagcccggcagcactgctcatcggctggggtattactggcgctggcattttattgctggcctttgccatgctgatcctcacgcgcattcgtcccgaacttgacggcggtatctttacctatgcccgcgaagggtttggcgagctaatcggcttttgttccgcatggggatactggctgtgcgcagtcatcgccaacgtctcctatctggtgatcgttttttccgcgttaagcttttttacggacacgccggaattgcgcctgtttggcgatggtaatacctggcaatcgatagtcggtgcatcggctttattgtggattgttcactttttgatcctgcgcggggtgcaaaccgctgccagcattaacctggtggcgacactggcaaaattgttgccgctgggtctgtttgttgtgctggcgatgatgatgttcaaactggataccttcaagctcgacttcaccggacttgcacttggcgtacccgtttgggaacaggtgaaaaacaccatgctgatcaccctgtgggttttcattggtgtggaaggtgccgtggttgtttctgcgcgtgcgcgtaataaacgtgatgttggcaaagcgacactgctggcggttctctccgctctgggcgtttacttgctggtaacgctgctttcgctgggtgtggtggcacgtcctgaactggctgaaattcgtaacccgtcaatggccggtctgatggtggaaatgatgggaccatggggcgaaatcatcatcgctgccggtttgatcgtttccgtttgcggcgcgtacttaagctggaccatcatggcagcagaagtaccgttcctggccgccactcataaagcattcccgcgcatttttgcgcgccagaacgcacaagctgcgccatccgcctcactgtggttgaccaacatctgcgtgcaaatttgtctggtactcatctggctgaccggttccgattacaacacgttgctgaccatcgcctcagaaatgattctggtgccctatttcctggtcggcgcgttcttgctgaaaatcgcaacccgtccactgcataaagcggtaggtgtcggtgcctgcatttatggcttatggttattgtacgcctctggtccaatgcacttgctgttatccgttgttctgtatgcaccggggctgctggttttcctgtacgcgcgcaaaacgcatacccatgataatgtactgaaccgtcaggaaatggtgctgattggcatgctgttaattgcctcagttccggcgacctggatgctggtgggataacgttcatcccatcgttggatagcaaaggagataacgatgggtaaaacccagcccttgccaatattaattactggcggaggtcgtcgcatcggcctcgccctcgcatggcatttcattaatcaaaagcaaccggtgattgtcagctatcggacacactatccagccattgatggactgattaatgcaggtgcgcagtgtattcaggctgatttttcgaccaacgacggtgtgatggcgtttgccgatgaagtactaaaaagcacccatggtctgcgtgctattttgcataacgccagtgcgtggatggcggaaaaaccgggtgcgccactggccgacgtactggcttgcatgatgcagatccacgttaataccccatacctgctcaaccatgcgctggaaagattactgcgtgggcacggacacgccgccagcgatatcattcactttaccgattatgtggtggagcgcggtagcgacaaacatattgcgtatgctgcaagcaaagcggcactggataatatgacccgctcgtttgcccgcaagctggcaccggaagtgaaagtgaattctattgcgccatcgctgatcctgtttaatgaacatgatgatgccgaatatcgacaacaggcgctgaataaatcactgatgaaaaccgcgcctggcgagaaagaagtgatcgacctggtcgattacttacttaccagttgctttgtcaccggacgcagtttcccacttgatggcggtcgtcatctgcgttaatgcagctttatccagcatataatcaacacccatgcgcttatcccccaacacgcaacagaaccaacaaaagcggcgggcaagcgcatcattccggtgaaataccacagcgacaccaggtaaacaaaatagggaataatcgaccacatactaaaaatgatggttgcgcgtaaggcttcaatgccgcgttcgctggcaacaatataatgcgcgataagcgcaaaggtcgggaaaagtggaatcagcccggcgatataataatttttcgtttttgctaaaacaccaatcaacagcactaccagcgcaccgagcgcggctttgattaccagccccatctttttaccttaacacttccataacaagtcatcagtagaatacctgatgaaaacttgtttagaaacgattgatagtaagtaaaaacagcgcggtgtattgtgacgtttttatatctaccgtgaatgttatgaacactatcgtatttgtggaagatgatgcggaagtcggttcactgattgccgcgtacctggcaaaacatgatatgcaggttaccgtagagccgcgcggcgaccaggccgaagaaaccattttgcgagaaaatccggatttggtgttactcgacatcatgctaccaggcaaggacggcatgaccatttgtcgtgatttacgcgcaaagtggtctggaccgattgttcttctaacctctctcgatagcgatatgaaccacatcctggcactggaaatgggtgcctgcgactatattctcaaaacgacgccccctgctgttttgctagcgcgtttacgtttgcatttgcgtcagaatgagcaagccacactgaccaaaggtcttcaggaaacgtctctgactccctacaaagccctgcatttcggcacgttgaccatcgatcccatcaaccgcgtagtcaccctggctaacactgaaatctcgctctcgacagctgatttcgaattattgtgggaattagctacccatgccgggcaaatcatggaccgcgatgcattgctgaaaaatttacgcggcgtcagttatgacggactggatcgtagcgtggacgtggctatttcgcggttaagaaaaaaactgctcgataacgccgcagaaccttatcgcattaaaactgtgcgtaacaaaggctatctttttgcgcctcatgcatgggaataagcgatgaaaaaactgtttatccagttttacctgttattgtttgtctgcttccttgtgatgtctctgctggttgggctggtgtacaaatttaccgccgaacgcgcgggcaaacagtcgctggatgatttgatgaacagttcgctgtatctgatgcgcagcgaattgcgtgagatccccccacacgactggggtaaaactctgaaagagatggatttaaatctctctttcgatctgcgtgtcgagccactgagtaaataccatcttgatgatatttccatgcaccgactgcgtggcggcgaaattgtcgccctggacgatcagtacacgtttttgcagcgtatcccgcgcagccactacgtgctggcagttggtcctgttccttatctttattatctccatcagatgcgattgctggatatcgccctgatcgcttttattgctatttccctcgcctttccggtgtttatctggatgcgtccgcactggcaggatatgttaaaactggaagcagcggcgcaacgatttggcgatgggcatctcaatgaacgtatccactttgatgagggttcgagctttgaacgacttggcgtcgcatttaaccagatggcggacaatatcaacgccttaattgccagcaaaaaacagcttattgacggtatcgctcacgaactgcgaacaccgttagtgcgcctgcgttatcgactggagatgagcgataacctgagcgccgccgaatcccaggcgttgaatcgtgatatcagtcaacttgaagctttaattgaagagctgctgacttatgcccgactcgatcgcccacaaaacgagcttcatcttagcgaaccagacctgccgttgtggctgtcaacgcatctggcagatattcaggcagtaacgcccgataaaacggtacggataaaaacgctcgtgcaaggccattatgcggcgttggatatgcgcttaatggagcgcgtgctggataatttgctcaataacgccctgcggtactgccattcaacggttgaaaccagcctgctactgtcggggaatagagcgacattaattgttgaggatgatggcccagggattgccccagaaaaccgcgaacatatctttgaaccttttgttcgcctcgatcccagccgggatcgctcaaccggcggctgcgggctggggctggcaattgtccactctatagcactggcaatgggcggtacggttaattgtgacaccagcgaactgggtggtgcccgcttctcgtttagctggccgttatggcataacatcccgcaatttacctctgcctgacactacgcgcacgatggtcaagtcaccacgactgtgctataaaataagtatgttgtaactaaagtggttaatattatggcgcgttacgatctcgtagaccgactcaacactacctttcgccagatggaacaagagctggctatatttgccgctcatcttgagcaacacaagctattggttgcccgcgtgttctctttgccggaggtaaaaaaagaggatgagcataatccgcttaatcgtattgaggtaaaacaacatctcggcaacgacgcgcagtcgctggcgttgcgtcatttccgccatttatttattcaacaacagtccgaaaatcgcagcagcaaggccgctgtccgtctgcctggcgtgttgtgttaccaggtcgataacctttcgcaagcagcgttggtcagtcatattcagcacatcaataaactcaagaccacgttcgagcatatcgtcacggttgaatcagaactccccaccgcggcacgttttgaatgggtgcatcgtcatttgccggggctgatcacccttaatgcttaccgcacgctcaccgttctgcacgaccccgccactttacgctttggttgggctaataaacatatcattaagaatttacatcgtgatgaagtcctggcacagctggaaaaaagcctgaaatcaccacgcagtgtcgcaccgtggacgcgcgaggagtggcaaagaaaactggagcgagagtatcaggatatcgctgccctgccacagaacgcgaagttaaaaatcaaacgtccggtgaaggtgcagccgattgcccgcgtctggtacaaaggagatcaaaaacaagtccaacacgcctgccctacaccactgattgcactgattaatcgggataatggcgcgggcgtgccggacgttggtgagttgttaaattacgatgccgacaatgtgcagcaccgttataaacctcaggcgcagccgcttcgtttgatcattccacggctgcacctgtatgttgcagattaacgcccggctttcatactgccgaccatctgttctggccgtacccagctgtcaaactcggcttcgctaagataccccagcgcaagggccgcagcttttaaggtcagcccttctttatgcgcttttttggcgatctcggcggctttgtcataaccaatgtgggtgttaagcgcagtcaccagcatcagcgattcattgagtaattgattgattcgctcacgattcggttcaatacccactgcgcagtgtttgttaaaactttccatgccatctgccagcaagcgcaccgattgcaggaaattgtggatcaccattggacggaagacgttcagttcaaagttaccggaagcgccccccatgttgatcgccacgtcgttccccatcacctgacagcagagcatggttaatgcctcacactgtgttgggttcactttccccggcatgattgagctgcccggctcattttccgggattgagatttcaccaattccgcagcgcgggccagaggccagccagcggacatcattggcgattttcatcagtgacgcagccaaccctttcaacgcgccgtgcgcctgaaccagggcatcacaggtcgccagcgcttcaaatttgttcggcgcggtaacaaacggtgcacaggtaatgactgccagttcatctgctacgcgacgcgcatactccggatgggtatttagtccagtacccaccgctgtaccgccaagagccagttccgctacgtgaggcaggctgtattcgatatgtttgagattatgctcgagcatcgctacccagccggaaatctcctgccccagcgttaacggcgtggcatcctgcaagtgagtacgaccaattttgacgatatcggcaaaagcacgggatttctcattcagtgtctgtgtcagggttttaagctgaggaatgagttgcttgcgcagcgccagcagcgccgcaacgtgcatcgccgtcggaaagacatcgttggaactttggcttttgttcacgtcgtcgttagggtgaactttacgttccatcccgcgcacaccgccgagtaattcactggcccggttagccagcacttcgttcatgttcatgttactttgcgtgccggagccggtctgccagatagccagcgggaattcgtcgtcatgctgtcctgccagtacttcatccgccgcctgacgaatggcgctcgctttctcttcagacaacaagcctaaatcttcattaacttttgccgctgcacgcttggttagcgccagcgcatgaatcagtgaggtgggcattttctccgtcgaaatgcggaaatgctccagcgagcgttgagtttgtgcgccccacagcttatctgccgggacatcaatcgcccccatcgaatctttttcgctgcgtactgtattcatgacctgctcctcacctgattaattttttctttctgttttgctttcgttaagcaacttttagctcacttattatttaccatttgataacaaatgtttggtctttcgtgccatgtaaaaaaaccgccccgaagggcggctctgtttatttcacacagcgggtgcattgtgtgagttgtatctgctggaagaagtcatttcctttatcatccacaaggataaacgccgggaaatcttccacttcaattttccagatggcttccattcccagttccggatattcaacacattccaggctcttaatacttccctgcgccaatacagcggccggaccaccgatactgccaaggtagaagccgccgtgttttttacaggcatccgtcacctgctggctgcggttgcctttcgccagcatgatcatacttccgccctgcgcttgcagttgatcgacataagaatccatccgtccggcggtcgttgggccaagagaaccggaggcataaccttccggcgttttggccggacccgcgtagtaaatcggatgatctttgatgtactgcggcagcccttcaccgttatccatccgctctttcagtttggcgtgagcaatatcacgaccgacgataatcgtgccgttaagcgataagcgtgtagaaacgggatactgcgacaactgtgcgaggatctctttcatcggacggttaaggtcaacgcgcaccgcttcgccttctcccgctttgcgcagctcttccgggatatatttgcctggattatgttccagtttttcgatccagatcccctgacggttgatcttcgctttgatattacggtcagcagagcaggagacgcccataccgaccgggcaggatgcgccgtgacgtggcaggcgaatcacgcggatgtcgtgagcgaagtatttaccaccaaactgcgcacccagaccaagattttgcgcttcgatcagcaattctttttccagttccacatcgcggaacgcctgaccgtgctcattcccttccgttggcagttcatcatagtatttcgcggaagccagtttcaccgttttaaggttcgtttctgcagaagttccaccaataacgaacgcaatatgatacggaggacaggccgccgtacccagcgtgcgcatcttctcaaccaggtaatttttcagtttccccggcgtcagtaacgctttggtttcctgatagagatacgtcttgtttgccgaaccaccacctttggcgatacagaggaatttgtattcgtcgccatcaacggcataaagatcgatctgcgctggcagattggtgccggtattcacttctttatacatatccagcggcgcgttttgcgagtagcgcagattatcttcgatataagtgttatagacaccgcgcgccagcgccgcttcatcaccaccaccggtccatacacgctgcccttttttaccaacaataatcgcggtgccggtatcctgacaggttggcagaacgcctttcgccgcgatgtcggagttacgcaggaattgcagcgccacatatttatcattttcgctggcctccgggtcacgcagaatgtcggccacctgttgttggtgcgccggacgcagcatgaacgacgcatcatgaaacgcctggcgcgccaacagagttaacgcttcgggtgcgactttcaaaatctcctgcccttcaaattcagatacgctaacgtgttcgctggttagcaggtaatactcagtatcatcttttttgagtggaaaaggagcctgataatgaaagggtttgtttgacattgttctctcacttactgcctggtttggttatgctctgggcgggtgttccgttgccctgttaaaagcgagtaacaatatcctacacacttttttaacaaaaactgagactagtacgactttttgcggctccaggttacttcccgtaggattcttgctttaatagtgggattaatttccacattaaaacagggattgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagcttattaaaggcttataacaccttcaggcggccagtccgcctgatttcattttatggataatcattatgaataaatcgctggtagcggtaggcgtcattgttgcgctaggcgtagtctggacaggcggcgcatggtatacaggcaagaagattgaaacccatctcgaagacatggtcgcgcaggcgaacgcgcaactcaaactgacagctcctgaatccaacctggaagtgagttatcaaaactatcatcgcggcgtattcagcagccagttgcaactgttggtgaaacccattgccgggaaagaaaatccgtggattaaaagcggtcagagcgtcatcttcaacgaatcggttgatcatggtcccttcccgcttgcccagcttaaaaaactgaacctgatcccgtcgatggcatcaattcaaaccacgctggttaataacgaagtaagcaaaccactgtttgatatggcaaaaggtgaaacgccttttgagattaactcgcgcattggttacagcggtgattccagttccgatatttcgctcaagccactgaattacgagcaaaaggatgaaaaagtcgcctttagcggcggcgagttccagttaaatgctgacagagacggcaaagccatctccctttccggggaggcgcaaagtggtcggatagacgcagttaacgaatacaaccagaaagtgcagttgacctttaataatctgaaaaccgacggttccagcacgctggcaagttttggtgagcgtgtaggaaatcaaaaactgtcactggaaaaaatgaccatttcagtggaaggcaaagaactggcactgctggaaggcatggagatcagcggtaaatcggatctggtcaatgacggtaaaacgatcaatagccaactggattactcgctaaacagcctgaaggtacagaatcaggatctgggcagcggcaagctgactttaaaagtcggccagattgatggtgaagcctggcatcagtttagccagcaatataacgcgcaaactcaggcgctgctggcacagccagaaattgccaacaaccccgaactttatcaggagaaagtgacggaagccttctttagcgccctgccgctgatgctgaaaggcgatccggtgattactatcgcgccgctaagctggaaaaacagtcagggtgaaagtgccctgaatctgtcgctgttcctgaaagatccggcaacgactaaagaagcgccgcaaacgctggcgcaggaagtagatcgttcggttaaatctctggatgcgaaactgaccattccggtggatatggcaactgagtttatgactcaggtagcgaagctggaaggttatcaggaagatcaagcgaaaaaactggcgaaacagcaagttgaaggtgcatcagcaatggggcagatgttccgtctgaccaccttgcaggacaataccatcaccaccagcctgcaatatgctaacggtcagataacgttaaatgggcagaaaatgtcgttagaagattttgttggcatgtttgcgatgccagctcttaacgttccggctgtaccggcaattccgcagcagtaattcacggccaaaacgccggagaattttcactccggcgttttcatctgaaaacaaaccagagattgcctgatgcgctacgcttatcaggcctaccttttcctgcaacactttgaatttatgagtttttgtaggctggataaggcgtttacgccgcatccggcataaaaaacgcgcactttgtcaacaatctgaaacgccggagatttttctctccggcgttattttttacttcagcataaagtcatactgaatactcattttcacatcccagtaattcaggcgatcgcccagcgtactgccatcgcgcttttcccgccctttatcggcagcaagaaagaaattcatcccttgtaacggcccttcgctgacccgatagttcataccacctaagatacccgtgccttcaatccgcacatctcgtttactggattcatagccgcgagtcacaatcggtgcaaatgtcagcgtaaattgcggcgttaaacgatagttgacgcccaattgccaggactgcattccttcacggttacgatcaagacttaatgaaaagggatagccaatgtcggtatccaccacggcaccattcattgcatggcgcaaataaccaccactgccaaatacacttccccacggcgcattccaggtcaattgtccactaaccaacgccgtttcattgggctggctggtattacgacttaaaccttcgagctgcgcgtaaaagccgagcaactcccctttcaacgtataattcgggtcgagcggtatgcttttctcgagaatactttgtatctgattggaaacatctttctgtaccgatgcccccagagaatagcgactggtatcatcatgccaactggcggctaaaaaagaacgtgcgcgatgtttatcgtattttcccgtctggctgttatacaccccttcatcacgaataccggttgttgaatcagtccataaaaatactcgtgaacgccacattccccacagatcaatatttggtgttaaagcccaataacctaatgctccttcagaaactgtcggtaatgtacgttgcgaactgccagccattaacggaatacgataaggtaagctaccataactataatccgtcccgaagcgacctaatttaagcaggctattttcactgggttttatttttactgcccccagggcaaagccaaaacttttatcaccatcaagataccaccgggtactcatatcagcacgagcacctaatttataaacataatacgccccgccttcaacgccaataatattggaataataaccactattgaaatcgagcaatcctccctgtacccatgcgtaaatatctcttcccgcgccagcactgggcttatccgccctgcgcaattcgtttttcagtctgatgcgtagtcccgcttcatcgtcagccagttgcgccgcataagcagaggtaaggccagaggcagccgtcaggcaaataacggccatggccactatttttctcatagttgcacctttgatgttctgattatttttattgaatattaattagtgatatcgctgattaattgctgctgcacttttttacgattatcaatttcaaccacgatttctttgaattttttatccgtgagcggataaaaccagataataacgaatgccagtagcataaatccgcaaggtactaaggcaattgatgtgcggatgcccataataacttccggcgtttgcacctgattggcgatatatccgcttaaccccaaaataaaggcaggaattgaacctccgattgcctgaccgcatttacgggtaaatgagaatagtgaataggtgagcccttcaattcgcacgccggtcaggtattcaccgtattctacggtatcagcttccagcgcccacatcacggtcatggtaacgccctgaccaattgaagcgatggccaacgcaaccaacgccaccggcagtgaccagacggaaacccagaagaacagcagataaccgcaggttcccagcaaagcgccaatcaggaaggtattctttttaccgatcctcgcgaccatccccggcaccagcggtgccgatgccacagtaccaaccaggttttgcaccagtaccagcacagtgaacagcccggtatcatttaacacatagcgcacgtagaacaacgacgaggcgctgaccgcaaaggtcgaaatcagcacacacagcgcaccgatgcacaacataaacagcgggcgattccgtttcagggtttgcagactgatattcaatgacggctgcgcaacgatacgtaccacattctcacgcgtcgatttgaagcagatgaagtaaagcaccattccggcaatcgccagcacaattgtccagaaatggtataccgacaccatctcttccgggctggagttcttaatgctcggtcctatcagaaatgccaggcagacaaaggtcaatgaagcggcaatcccacgagccgcgcccagacgggcgcgggattgtggttgttgggtcatcgcggtagcaagtgaaccataaggaatattcaccaggctgtagcaaagcccgaggcccatgtaggtcaaatatgcatacaccactttgctaccatggctccagtcggtcagcacccagaataccagcacgctgaagatcattaacggcgcagtaccgaagagtaaaaacgggcggaattttccccagcgggtattcacactgtccaccactcgtccggcaaagacgtcggcgaaggcatcgaatacccgcaccagtaacagcatggtgcccgccgcagcggcaccgacgccagcgacgtcggtgtagtaactcaacaggaagagcgcccccattgcgaaggcgaagttattggcgacgtcaccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggatcccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacgtaacataagggactcctcattaagataataatactggtcaacctttaatctgattagttaaccaattctgtgttgcacacagttatctgtgagaaacccatggaagagaaatggaaataaaaagaactgacaccgcgatcaaaaaaccaaaaactgcaatacccacagcgtgatatagatcgcattaatctttaaaacagcgttgacagaagccataaaataagcaaccgaacgttcgttcgagcgtattgggaacgataaactctcatgacatatggctacagtgaatattttggggggaattctccgaagccgggaaggataatttttgcacagagaaattacgatatgaaacgcgggcacagttatcaccagcccgccgaaaaagagagagaatcaggatgcggttaagataccgccaatcatcgcgcgtaatccctgagcaaacgacgcttcacgcgccaggtcttccgcttcgatatcggccagtacaccgtaggtcagatccagcagtaaacgtgaagtcattgccgtgttgatgtctgggcttatctcgcctttttgctgggcatcacgcatccgctgggcaacaaattccgtgatcgtcatatgcttatttttaagcatggcggcgacctgtgggttacgcatcccttccgccataatttcaaccaccagcgcccgttgtccaaaggcttcatgggtgagagagacaatggactcgaccatatagtcaacgaaatgaatcccttcaatcggttcccggaaacgggccagcgccctctcctggtcctgtaagataatcgcctgaatcaaggcttctttggagatgaaatggtgatagagcgtcccgggactaatggcgcaagatttacagatggctttcatcgaggcactgtgaaatccattttctgaaaaaatctctctggcagcattgaggatccgggtccgtgtcggttgtgcttcagtctgcatgttatccatcattaaaccattatagttagcgtgaataactagtttaccgcgttgtcaggtgagcgcctatcattgctgttgaatagtgcgaaggcacactctattcgtatacttttcactctgaaattggttaaccaatagccgtgatttggctgccagttatttagcagagacgttgatgagtttatcccggtaaacaacacgcacggttgtttaccggtccgttagtgtattaattgagctcctgtaccccaccaccggagacggtgagaatttgtccgcttacccagctcgcagcaggcgagcaaaggaacagcgctgcgttagcaatatcttgcggttggcccagacgtctgatcggcgtgtgctgtaacattttttgttcaatttctggtgtaataacggatttcagggcatcggttaatattgcccccggcgcaatgccatttacccgaatatttttttcacccaggtcaaacgccatatttctgaccagatgactggccgcagctttagatgatgcataggaagtcatgtttatatttttattttctgccgccatagaagtgatggtcagaataacgccaccgccatttttttccatttctggcgcaacaagttgtgacagatggaaaaaagaaaacacattcagttcataagcacggcgaaaatccgccattggcatatcaaacggtttaggtccaccgccaccggcgttgttaaccagaatatcaactttacccagcttactgatagcaaagtctgccagtgcagagagttcctgttcggaagtaatatcacaacggcaggcaaatgcctgaccacccagttgttgaatttcgtctacaacatggttagctgcgtcggcgttaatatcactgaccaccacagatgcgccagctgtcgcgaatgtaatggcgatttctttaccaatacctgcacccgcacctgtgatgatggcgcattttccgtcgagtctcaggttgtcagaattaaacacataaacctcctgtgaacttcagtaaaaataaaaggcaccgcctgtgtgccacattttttatcattaaccttgaggaaaggacactaccaggtatagcagataaagagaggattatttcgctgcaatgagccgggcgggaataataagattgcgtgaatgcgtctcttcatgggtgattttttgcatcatgcgatccgcaagtgtgataccaagttcccgcgctggcgtgctggcccaggtaacaggtatatcatcaagtgtggttggtgtcgcatcggtaaatgccgccagcgaaacctgttgctcaaagtaacgatcgactccgctttccccgctttgccgccctgctttgagcaaaccaaaccatgcccccatcgcaatagtttcgttatagcaaaccacggcactgatggtcgggttatgacgtaaaagcgccgtgatagcttccgcggcttgcttctggctggaagtgcactccaacacccaatcgctatgaaacggcaggccaaattttagtagagttgcacaatagcccccaacccgttctgcacgggttaatgaggaactttgccctcccagccaggcgatccgctgatgcccattgcgaatgagatgctccgtcaacaactgtgcagcctgcatgttgtccgggcgaaccgtatcaacatcatcaagataactggcacgggaagcgaaaatcaccgggatagctttttcttctgccatccgtcgcaggtcatcgctacttcctgcagctccggcaattaccacaccatcgacaccctgattcagtaacagtgaaaaccgctgtgccagctgctcaccgtctttaccgccgtgaagcaaaaaaaccatccgtccctgcgcttccagagcttccgtcaatccggccgtcaattcggcgtaaaacggcgcagataaatcacggacgatcaaaccaatgacgccgctttgcccgccgcgcagcgccgacgcctggcgattgcgcacaaatcccagctcttcaatggcggcgttaacgcgttctcctgtggcggtagagattcgccctttgccactaagcaccagcgaaacggtacttaccgacacgcccgcagccagcgcaacatcatgaatggttatttttttggcggtagccatgcagatgacctactccctgattatgtgacagataaaacgttttaccttttatttatcttatacccgctattatcgttgcgtaatgtgatttatgcctcactaaaatttgataaaacgttttatcttctcgcgcaatttactgaatccagattgttctctacgaggagtcgttttatgacggcgaaaacagcaccgaaagtcacgctgtgggagttcttccagcagttaggcaaaaccttcatgttacccgtggcattattgtcgttctgcggcattatgctcggcattggtagttctcttagcagccatgatgtcataaccctgatcccggtcctgggcaaccccgtgttgcaggctatctttacctggatgagtaagattggctcgtttgcttttagtttcctgcctgtcatgttctgtatcgccatcccgctgggcctggcacgcgaaaataaaggcgtagcggcattcgctggcttcatcggttatgcggtaatgaacctcgcggtaaacttctggttgaccaataaaggcattctgccaaccacggatgccgcggttctgaaagccaataacatccagagcattcttgggatccagtcgatcgataccgggatcctcggtgcggtgatcgccggtattatcgtctggatgctgcatgagcgtttccataatatccgcctgccggatgcgctggcattcttcggcggtacgcgcttcgtaccaattatctcctcgctggtgatgggccttgtcggcctggtgattccattagtctggccgattttcgccatgggtattagcggcttgggccatatgataaacagcgcgggtgatttcggaccgatgctgtttggtaccggtgaacgtctgctgttgccgtttggtctgcatcacattctggtggcattaattcgctttaccgacgcaggcggcacgcaggaagtctgcggtcaaaccgtcagcggcgcactgaccatcttccaggcgcaattgagttgcccgaccactcacggtttttctgaaagcgccacgcgtttcctttcgcaaggtaaaatgcctgcgtttctcggcggtctgccaggtgcagcgttagctatgtatcactgcgcgcgcccggaaaatcgccataaaattaaaggtctgctgatttctggcctgatcgcctgcgtcgttggcggcactaccgaaccgctggaattcctgttcctgttcgtagcgccagttctgtatgtcatccacgcgctgttaaccggcctcggcttcaccgtcatgtctgtgctcggcgtcaccatcggtaataccgacggcaatatcatcgacttcgtggtgttcggtattttgcatggtctgtcaaccaagtggtacatggtgccagtggtggcggcaatctggtttgtcgtttactacgtcatcttccgtttcgctatcacccgcttcaatctgaaaaccccggggcgcgatagcgaagttgccagctcaatcgaaaaagccgttgccggtgcgccgggtaaatcaggttacaacgttcctgcaatcctcgaagcattaggcggtgccgacaatattgtcagcctcgataactgcattacccgtctgcgtttgtctgtgaaagatatgtcgcttgttaatgtgcaggcactgaaggacaatcgggcaattggcgtagtacaacttaatcaacataacctgcaggttgttatcgggccacaagttcagtcagtaaaagatgaaatggccggtctgatgcatactgtccaggcataaggataagatatgttcgatttttcaaaggtcgtggatcgtcatggcacatggtgtacacagtgggattatgtcgctgaccgtttcggcactgctgacctgttaccgttcacgatttcagacatggattttgccactgccccctgcattatcgaggcgctgaatcagcgcctgatgcacggcgtatttggctacagccgctggaaaaacgatgagtttctcgcggctattgcccactggttttccacccagcattacaccgccatcgattctcagacggtggtgtatggcccttctgtcatctatatggtttcagaactgattcgtcagtggtctgaaacaggtgaaggcgtggtgatccacacacccgcctatgacgcattttacaaggccattgaaggtaaccagcgcacagtaatgcccgttgctttagagaagcaggctgatggttggttttgcgatatgggcaagttggaagccgtgttggcgaaaccagaatgtaaaattatgctcctgtgtagcccacagaatcctaccgggaaagtgtggacgtgcgatgagctggagatcatggctgacctgtgcgagcgtcatggtgtgcgggttatttccgatgaaatccatatggatatggtttggggcgagcagccgcatattccctggagtaatgtggctcgcggagactgggcgttgctaacgtcgggctcgaaaagtttcaatattcccgccctgaccggtgcttacgggattatagaaaatagcagtagccgcgatgcctatttatcggcactgaaaggccgtgatgggctttcttccccttcggtactggcgttaactgcccatatcgccgcctatcagcaaggcgcgccgtggctggatgccttacgcatctatctgaaagataacctgacgtatatcgcagataaaatgaacgccgcgtttcctgaactcaactggcagatcccacaatccacttatctggcatggcttgatttacgtccgttgaatattgacgacaacgcgttgcaaaaagcacttatcgaacaagaaaaagtcgcgatcatgccggggtatacctacggtgaagaaggtcgtggttttgtccgtctcaatgccggctgcccacgttcgaaactggaaaaaggtgtggctggattaattaacgccatccgcgctgttcgttaaccccaattgcgcaacgtaaaaaatcgttgcgcaatcgtggatttttaccctgctttgtttttataatggtgcgcacttttatatccagaaaaagagtgcgaccatgattgataccaccctgccattaactgatatccatcgccaccttgatggcaacattcgtccccagaccattcttgaacttggccgccagtataatatctcgcttcctgcacaatccctggaaacactgattccccacgttcaggtcattgccaacgaacccgatctggtgagctttctgaccaaacttgactggggcgttaaagttctcgcctctcttgatgcctgtcgccgcgtggcatttgaaaacattgaagatgcagcccgtcacggcctgcactatgtcgagctgcgtttttcaccaggctacatggcaatggcacatcagctgcctgtagcgggtgttgtcgaagcggtgatcgatggcgtacgtgaaggttgccgcacctttggtgtgcaggcgaagcttatcggcattatgagccggaccttcggcgaagccgcctgtcagcaagagctggaggcctttttagcccaccgtgaccagattaccgcacttgatttagccggtgatgaacttggtttcccgggaagtctgttcctttctcacttcaaccgcgcgcgtgatgcgggctggcatattaccgtccatgcaggcgaagctgccgggccggaaagcatctggcaggcgattcgtgaactgggtgcggagcgtattggacatggcgtaaaagccattgaagatcgggcgctgatggattttctcgccgagcaacaaattggtattgaatcctgtctgacctccaatattcagaccagcaccgtagcagagctggctgcacatccgctgaaaacgttccttgagcatggcattcgtgccagcattaacactgacgatcccggcgtacagggagtggatatcattcacgaatataccgttgccgcgccagctgctgggttatcccgcgagcaaatccgccaggcacagattaatggtctggaaatggctttcctcagcgctgaggaaaaacgcgcactgcgagaaaaagtcgccgcgaagtaacaaaatggatggtgcaaatgcaccatccatttttcatgcaaggcacaaagtcgcgcgatgtttggcggattcgatgcccagctcaatcaactccattacctggattgcctggcttgccggaaccggattttcaccatcgccatttaacgcatcacgaatagccgcatagtaagccggataattcccaggcaccgtcaacagcgtttcttcgacacgttcctcaccttccacgcgggtaagtacgccatcacgcatatcgtagccccagtcttcctgcggtagacgctcgccatttttcagacgttcttcctgtggatcgaggccatatttcacataactgcctcgggatccatgcacgatataccgtgctgactcagcggctgccagcatggtaccgtgtaaaatgactcgccgctgtggataggacaagatggcgtggaaataatcggtcgactgcgctccgggccgtaactgtgccaaatctaccgtcatgctgaccggtaaaccaaaaagcgtaatggcctgatcaagaagatgtggtgctaaatcgtaccagataccgctgcctgggccgccctgttcacgccaacgatcgcgcacctgcggacggaagcggtcaaaatgagactcaaagtaagcaacttcacccagcacgccttccgcgagtaaaccttttagcgtcaagaaatcgctatcccagcgacggttatggaatacagacagcacacgccccaggctttttgccagcgcatccagctctcgcgcttgtgacagtgtcacggtaaagggtttatcaacgaccacatgtttacccgcctcaagcgccgctttggctaacgggaaatgggtatcgttgggtgtaggaatgacaatcaggtctatgttgggatcgttaaacagatgcttcggctcagagacaaccgtaaccgttggccagtcggcttttacttttgtttcatcactgctggagattaccgccagttcctgcccgggcgtgcccgcaatcaggggcgcatggaaggttttgctcgcataaccatacccaatcaacccaacacggatgttgtcgctcatgtcattgcctctcattgaagtatgatggctatttgacactatcctttacccacgctcaacagtttaataacctgccagcaataagggatgttgtttaacttaagtcaaaaaaatagcgaattttccaacgacaaaagctaaatatcgcaaaaacctcagtaaaaatcttgctggagctattattgctaagtaacatttaccccctgaagttaatggatcaatcaagagagatgtgggctgtaatgaatcgtcttattgaattaacaggttggatcgttcttgtcgtttcagtcattcttcttggcgtggcgagtcacattgacaactatcagccacctgaacagagtgcttcggtacaacacaagtaagctctgcacttgtggagcgacatgctgcccgtccgggtgcatgttttcacttgtcggatattaaaccaggaatttattatcttgttcgatgttgttggtgattgtcagggatagtaaagcgcgttactcttttcagagcagtttttcatccctgaatatttgccatcagcgcattcttattattgtaataacacaagcgttcacttttggtgaaattttatcatcactaataatacctacccctttggtattaattattttatggaccttttatgactgttcaggactacttattaaaatttcgcaaaatcagttcactcgaaagtctggaaaaactctacgaccatcttaattacaccctgacggacgatcaggaactgatcaatatgtatcgtgctgccgatcaccgtcgcgcagagctggtttctggcgggcgtttgtttgacctcggccaggtaccgaagtccgtctggcactatgtccaataaagaaagtagcgatcggttataaaagccttataataacgcccctaaaattagatttgcctgtttgcgtcgctattctggagaacctatgaccaccacaacgccacaacgtattggaggctggttgcttggcccgttggcctggcttttagtcgctctgttgagtacgacgctggcgttgttgctgtataccgctgcgttatcttctccgcaaacatttcaaacgctcggcggacaagcactgacgacacaaatcttatggggcgtttcttttattaccgctatcgccttgtggtattacacactgtggttgaccatcgctttctttaaacgtcggcgttgtgttcctaaacactatattatctggctgcttatttccgtattgctggcagtaaaagcattcgctttttcacccgtggaagatggcatagccgttcgccagttgctgtttactttgttggcaaccgcattgatcgtcccctatttcaaacgctcgtcgcgggtaaaagcgacgtttgtgaatccgtaataaccttacagttaacctgttgtcgcctgctctggattaacggataataggcggcttttttatttcaggccgaaaaatgactgactacctgttactgtttgtcggaactgtactggtcaataactttgtactggtcaagtttctcggtctctgtccgtttatgggggtttccaaaaaactggaaaccgcgatgggcatggggctggcaacaacgtttgtgatgacgctggcgtctatttgcgcctggcttatcgatacgtggattttgatcccacttaatctgatttacctgcgcaccctggcatttattctggtgattgctgtggtcgtgcagttcaccgagatggtggtgcgcaaaaccagcccggtgctttaccgtctgctggggatttttttgccgcttatcaccaccaactgtgcagtgctcggcgtggcgttgctgaatatcaatctcgggcacaatttcttgcagtcggcgctgtacggtttttccgccgctgtcggtttctcgctggtgatggtgctcttcgccgccatccgcgaacgccttgctgtggctgatgtcccggcaccttttcgcggtaatgccattgcgttaattaccgcaggtcttatgtctctggcctttatgggctttagtggtttggtgaagttgtaatgaatgctatctggattgccgttgccgccgtgagcctgctgggcctggcgtttggcgccattctgggttatgcctcccgccgttttgcggtggaagacgatccggtcgttgagaaaattgacgaaatcttaccgcagagccagtgtggtcagtgcggttatcccggctgtcgcccctacgcggaagccatcagctgtaacggtgaaaaaatcaaccgttgcgccccaggtggcgaagctgtgatgctaaaaattgccgagttgcttaatgtcgagccgcagccgctggatggcgaagcgcaagagataacgcctgcgcggatggtggcggttattgatgaaaataactgtattggctgcactaaatgtattcaggcgtgtccggtagacgccatcgttggcgctacccgtgccatgcatacggtaatgagtgatctctgtacgggctgcaatttatgtgttgatccgtgcccgacgcactgcatctcgttgcaaccggtcgcagaaacacctgactcctggaaatgggatctgaacaccattcccgtgcgtatcattcccgtggaacaccatgcttaagttattctctgcattcagaaaaaataaaatctgggatttcaacggcggcatccatccaccggagatgaaaacccagtccaacggtacacccctgcgccaggtacccctggcgcagcgttttgttattccactgaaacagcatattggcgctgaaggtgagttgtgcgttagcgtcggcgataaagtattgcgcggccagccgcttacccgtggtcgcggcaaaatgctgcctgttcacgcgcccacctcgggtaccgttacggctattgcgccccactctacggctcatccttcagctttagctgaattaagcgtgattattgatgccgatggtgaagactgctggatcccgcgcgacggctgggccgattatcgcactcgcagtcgcgaagagttaatcgagcgcatacatcagtttggtgttgccgggctgggcggtgcaggattcccgacaggcgttaaattgcagggtggcggagataagattgaaacgttgattatcaacgcggctgagtgcgagccgtacattaccgccgatgaccgtttgatgcaggattgcgcggctcaggtcgtagagggtattcgcattcttgcgcatattctgcagccacgcgaaattcttatcggcattgaagataacaaaccgcaggcgatttccatgctgcgcgcggtgctggcggactctaacgatatttctctgcgggtgattccaaccaaatatccttctggcggtgctaaacaattaacctacattctgaccgggaagcaggttccacatggcgggcgttcatccgatatcggcgtattaatgcaaaacgtcggcactgcttatgcagtgaaacgtgccgttattgatggcgagccgattaccgagcgtgttgtaaccctgactggcgaagcaatcgctcgcccgggcaacgtctgggcacggctggggacgccagtgcgtcatttattgaatgatgccggattctgcccctctgccgatcaaatggtgattatgggtggcccgctaatgggctttaccttgccatggctggatgtcccggtcgtaaagattaccaactgtctgttggctccctctgccaatgaacttggcgaaccacaggaagaacaaagctgcatccggtgtagcgcctgtgctgacgcctgccctgcggatcttttgccgcaacagttgtactggttcagcaaaggtcagcaacacgataaagctaccacgcataacattgctgattgcattgaatgtggggcttgcgcgtgggtttgcccgagcaatattcccctggtgcaatatttccgtcaggaaaaagctgaaattgcggctattcgtcaggaagaaaagcgcgccgcagaagccaaagcgcgtttcgaagcgcgccaggctcgtctggagcgcgaaaaagcggctcgccttgaacgacataagagcgcagccgttcaacctgcagccaaagataaagatgcgattgctgccgctctggcgcgggtgaaagagaaacaggcccaggctacacagcctattgtgattaaagcgggcgaacgcccggataacagtgcaattattgcagcacgggaagcccgtaaagcgcaagccagagcgaaacaggcagaactgcagcaaactaacgacgcagcaaccgttgctgatccacgtaaaactgccgttgaagcagctatcgcccgcgccaaagcgcgcaagctggaacagcaacaggctaatgcggaaccagaacaacaggtcgatccgcgcaaagccgccgtcgaagccgctattgcccgtgccaaagcgcgcaagctggaacagcaacaggctaatgcggaaccagaagaacaggtcgatccgcgcaaagccgccgtcgaagccgctattgcccgtgccaaagcacgcaagctggaacagcaacaggctaatgccgagccagaacaacaggtcgatccgcgcaaagccgccgtcgaagccgctattgcccgagccaaagcgcgcaaacgggaacagcaaccggctaatgcggagccagaagaacaggttgatccgcgcaaagctgccgtcgaagcggctattgcacgcgccaaagcacgcaagctggaacagcaacaggctaatgcggtaccagaagaacaggttgatccgcgcaaagcggcagttgccgcggctattgcccgcgctcaggccaaaaaagccgcccagcagaaggttgtaaacgaggactaaatggtattcagaatagctagctccccttatacccataaccagcgccagacatcgcgcattatgctgttggtgttgctcgcagccgtgccaggaatcgcagcgcaactgtggttttttggttggggtactctcgttcagatcctgttggcatcggttagtgctctgttagccgaagctctcgtactcaaactacgcaagcagtcggtagccgcaacgttgaaagataactcagcattgctgacaggcttattgctggcggtaagtattccccccctcgcgccatggtggatggtcgtgctgggtacggtgtttgcggtgatcatcgctaaacagttgtatggcggtctgggacaaaacccgtttaatccggcaatgattggttatgtggtcttactgatctccttccccgtgcagatgaccagctggttaccgccacatgaaattgcggtcaacatccctggttttatcgacgccatccaggttatttttagcggtcataccgccagtggtggtgatatgaacacactacgcttaggtattgatggcattagtcaggcgacaccgctggatacatttaaaacctctgtccgtgccggtcattcggttgaacagattatgcaatatccgatctacagcggtattctggcgggcgctggttggcaatgggtaaatctcgcctggctggctggcggcgtatggttgctatggcagaaagcgattcgctggcatattcccctcagcttcttagtaacgctggcgttatgcgcaatgttgggctggttgttctcaccagaaacactggcagcaccgcaaattcatctgctgtctggagcgaccatgctcggcgcattctttattttgactgacccggttaccgcttctacgaccaatcgtggtcgtcttattttcggcgcgcttgcgggcttattagtctggttgatccgcagtttcggcggctatcctgacggcgtggcttttgccgtcctgctggcgaacatcacggttcctctgatcgattactacacgcgtccgcgcgtctacggccatcgcaaagggtaaaccatgctgaaaactatccgaaaacacggcattacgttggcgctatttgcagcgggttcaacagggttaactgcggccatcaaccagatgaccaaaacgacgattgctgaacaggccagtctgcaacaaaaggcgttatttgatcaggtgctgccagccgaacgctataacaatgcgctggcacagagttgctatctggtaactgcgccagagttaggtaaaggtgagcatcgggtttacatcgccaaacaggatgacaaaccggtagccgccgttctggaagcaaccgcgccagatggctattccggtgcgattcagctgctggtgggagccgattttaacggcacggtacttggcacgcgcgtgacagagcaccacgaaacgccagggcttggcgataaaatcgaactgcgcctttctgactggatcacccattttgcgggtaaaaaaatcagtggtgcagatgatgcgcactgggcggtgaagaaagatggtggtgatttcgaccagttcaccggcgcgacgattactccccgcgcggtggttaatgcggtaaaacgcgccggattgtacgctcagacgttaccggcacaactttctcaacttcctgcctgtggagaataaagcgtgagcgaaattaaagacgttattgttcaggggttgtggaaaaacaactctgcgctggtccagttgctcggcctttgtcctctgttggcggtcacgtccactgccactaacgctctgggtttaggacttgcgactacgctggtactgacgctgaccaacctgaccatttcgacgctgcgtcactggacgccagccgagatccgcattcccatttacgtgatgatcatcgcctcggtggtcagcgctgtacagatgctgatcaacgcctacgcctttggcctgtatcaatcattagggatttttattccgctgattgtcactaactgtatcgttgtgggccgcgctgaagccttcgccgccaaaaaaggtccggcgctttcggcactggacggcttttcaattggtatgggcgcaacctgcgccatgttcgtgctgggttcactacgcgaaattatcggcaatggcacattgtttgacggtgcagatgcgctgttaggtagctgggcaaaagtattacgcgtggagattttccacaccgactcccctttcctgctggcgatgctgccaccaggtgcatttattggcctgggactgatgctggcaggaaaatacctgattgatgaaagaatgaaaaagcgccgtgctgaagcagctgcagaacgtgcattgccaaacggtgaaacagggaatgtctgatgaataaagcaaaacgcctggagatcctcactcgcctgcgtgagaacaatcctcatcccaccaccgagcttaatttcagttcgccttttgaattgctgattgccgtactgctttccgctcaggcgaccgatgtcagtgttaataaggcgacggcgaaactctacccggtggcgaatacgcctgcagcgatgcttgaactgggcgttgaaggggtgaaaacctatatcaaaacgattgggctttataacagcaaagcagaaaatatcatcaaaacctgccgtatcttgctggagcagcataatggcgaggttccggaagatcgtgctgcgcttgaagccctgcccggcgtaggtcgtaaaacagccaacgtcgtattaaacactgcattcggctggccgactattgctgtcgacacgcacattttccgcgtttgtaatcgtactcaatttgcgccggggaaaaacgtcgaacaggtagaagaaaagctactgaaagtggttccagcagagtttaaagtcgactgccaccattggttgatcctgcacgggcgttatacctgcattgcccgcaagccccgctgtggctcttgtattattgaagatctttgtgaatacaaagagaaagttgacatctgaagaaaaggggtaacaccgattaccccattgataacctttctttatcctcttttaaaacatctttttaacgtcaatgatgccattgcttagcgttatcatcaggtaatccgtttgcggataaccaaaaatgcaggttaattgtttttttaatagcgaaattttctattcattcgtgatcaagatcacgatgctgtcgcaatgtaaaaacattgcaagaatcaggttaaaatcatttaaatttacacacgcaacaaatattgacctacaaaacattacactggctatttttcagaaactggactatctcactagtaaaaacgctaaatagcagaacatatcgccgttaagccatcacccccctctcagtgcagtgaaaaaatctgccgttacgttttttgaaaaatttaacgctggataacatttcccggaatggttgaattccccgcctcagttatatgtaacagattattacaaaggacttgtctgaaagtgcaagatagtgaacattacctgccgtttcccctcccactataacaattgcgcgtatgttttttatacataacgcgagaaagcacccccgttaatatgggatgtaaaaaaagaggtaaaagtgtccactgcaaaccaaaaaccaactgaaagcgtcagtttgaacgctttcaaacaaccgaaggcgttctatctcatcttctcgattgagttatgggaacgttttggttattacggcctacaaggaattatggctgtttacctggttaaacaactgggtatgtctgaagcggattcaatcacccttttctcttcctttagtgccctggtttatggtctggtcgctatcggcggctggttaggtgacaaggtactgggtactaaacgcgtaattatgctcggcgctattgtgctggcgattggttatgctctggttgcctggtctggtcacgacgccggtatcgtttatatgggtatggcggctattgcggtcggtaacggcctgtttaaagctaacccgtcttctctgctttctacatgctatgagaaaaacgacccgcgtctggacggtgcattcaccatgtactacatgtccgtcaacatcggctctttcttctctatgattgctacgccgtggctggccgcgaaatacggctggagtgttgcgtttgcgttgagcgttgtaggcctgctgatcactatcgttaacttcgccttctgccaacgctgggttaaacagtacggttcaaaaccagacttcgagcctatcaactaccgtaacctgctgctgaccattattggtgttgtggcactgatcgctatcgccacctggctgctgcacaatcaggaagttgcgcgtatggcgctgggcgttgttgccttcggtatcgtggttatcttcggtaaagaagccttcgcgatgaaaggtgctgcgcgtcgtaaaatgatcgttgccttcatcctgatgctcgaagccattatcttcttcgtgctgtacagccagatgccaacgtcactgaacttctttgcgattcgtaacgttgagcactccattctgggtctggccgtagaacctgagcagtatcaggcactgaacccgttctggatcatcatcggtagtccgattctggccgctatctataacaagatgggcgataccctgccgatgccaaccaagtttgcaatcggcatggtgatgtgttctggtgcgttcctgattctgccgctgggtgcgaaattcgcgtctgacgctggtatcgtgtctgtaagctggctggtcgcaagctatggcctgcagagcatcggggaactgatgatctctggtctgggtctggcaatggttgctcaactcgttccgcagcgtctgatgggcttcattatgggtagctggttcctgaccactgccggtgcaaacctgattggtggttatgttgcgggtatgatggctgtgccggataacgttaccgatccgctgatgtcactggaagtctatggtcgcgtattcttgcagattggtgtcgctactgccgttattgcagtactgatgctgctgaccgcgccgaaactgcaccgcatgacgcaggatgacgctgcagacaaagcggcgaaagcagccgtagcgtaaaattcagggaaactcttttacaagccgctaacttttcgttagcggctttttttttgttcagcaacgcactaccatactttaaaccacagacaaaaggagttaccgatgaaattgttctacaaaccgggtgcctgctctctcgcttcccatatcaccctgcgtgagagcggaaaggattttaccctcgtcagtgtggatttaatgaaaaaacgtctcgaaaacggtgacgattactttgccgttaaccctaaggggcaggtgcctgcattgctgctggatgacggtactttgctgacggaaggcgtagcgattatgcagtatcttgccgacagcgtccccgaccgccagttgctggcaccggtaaacagtatttcccgctataaaaccatcgaatggctgaattacatcgccaccgagctgcataaaggtttcacacctctgtttcgccctgatacaccggaagagtacaaaccgacagttcgcgcgcagctggagaagaagctgcaatatgtgaacgaggcactgaaggatgagcactggatctgcgggcaaagatttacaattgctgatgcctatctgtttacggttctgcgctgggcatacgcggtgaaactgaatctggaagggttagagcacattgcagcatttatgcaacgtatggctgaacgtccggaagtacaagacgcgctgtcagcggaaggcttaaagtaatagccatcggcccacaggtcgttgtgggccgaaatgagatatttcagagctttgttgcgctgaagtaatgttctggtttggcaatacgatcctgagcagccaccacttgcagctcatattcctgcattgctttggtggtcaccatgatttcgtagactgcagcggtcacatgttccagcgcctcctgcagcgttgccccctgaagcagtttcaccagcagtaaaccgctcgtcacatcaccaacacctaccggctggcgcataccaaaatccaccagcggacggctgatatgccaggcttcatcggcggtgaccagcagcatttcaaaacggtcacggctgtagccagctcgcgccaggtgtttaaccaacacaatttgtggcccttgcgcaatgagttcgcgcgctgccagaaccgcttcttcgacgttatttaccgcatgctcacagagtatttccagctcaaccagatttggcgcaatgatatcgctggcaggcaaaccgtgccgcacatgaaactctgcgacacccggtgcaacgatacagcctttttccggatgacccattaccggatcgcaaaaatatttcgcctgcggattcgcggctttcacctgacggacgataccgaggatatgttcaccctgctccgccgatcccagatagccacttaatacggcatcacaggtgtgtaatttatcaatggcggcaatgccttgcacaatttcggttaaatggctgggcggcatcacgcagccagtccatttgccgtattgggtgtgattagaaaattgaacggtgttcagcggccagacgttcgcgcccaggcggcgcatcggaaactctgccgcactgttacccgcatgaccataaacaacgtgagactggatagcgagaatatttttcatcatgttccctgtataaaaaccagggggagtgatttctcactccccctttccacttaatgcattatttccagcaaatcagacagtaattctttttaccgcgacgcagtaaggtaaaacgaccaaacagacgatcttcttctttaaagaagtattcaggatcggactgtttttcaccgttaatggtgatggcattggaggcgatagttttacgtgcctgaccacgggaaggttgcagttcagaatcgaccagtgcctgcatcaggtctgcgcccttttccatctcaaccatcggtacgccgtcctgcgccagctgttcgaagtccgcttcactcagcgcactcaaagaaccgctgaacaggcattcggtaatacgttttgccgcctgtaaaccttcttcaccgtgaaccagacgagtcacctgctccgccagtacatactgggcgcgcggtgctttaccgctgtttttatcttcttcttccagggcgttgatctcttcaatgctcataaaggtgaagaacttcaggaagcggtaaacgtcggcatccgcagtgttgatccagaactggtagaatttgtacgggctggttttcttcggatccaaccagactgcgccgccttcagttttaccaaatttggtgccatctgctttagtgatcagcggaacggtcaggccaaacacctgattctgatgcagacgacgggtcaggtcgataccagaagtgatgttaccccactggtcagaaccaccaatttgcagcaccacaccgtactgtttgttcagacaggcgaagtcataaccctgcaacaggttgtaggaaaactcagtgaacgaaatcccctgatcttcacggttgagacgctgcttaaccgcttctttgttgatcatctggttaacggagaagtgtttgccaatatcgcgcaggaaggtcagcacattcatattgccgaaccagtcatagttgttcgccgcgatagcagagttttctccacagtcgaaatcgaggaacggggcaacctgcttacggattttgtccacccactcctgaacagtttcttcggtgttcagcttacgctcggcagctttgaagctcgggtcgccaatcagacccgtcgcgccgcctaccagcgcaaccggcttgtggcccgcctgctggaagcgtttcaggcataacaatggaacaagatgccccaaatgcaagctgtcagcggtaggatcgaagccgcaatagagcgcgatcgggccttgcgccagtcgctctgctaacgcttcctcgtccgtcacctgggctaccagcccccgctcttgcaattgtttaatcaagttactgcttgccatcaaaatctccatgtatataacgactgcacctttgccggtacacgacttttcgccagatgcgaaagagacatagaataaagtgccagaatcaggagtaccagcgattaaagcaagatttttgcatcttttcagggtgcaagacgatcaatcttccacgcatcattttcacgctggtacaaaaagcggtcatgcaggcgatgctcaccaccctgccagaactcaatctgttcaaggctgacgcgaaaaccgccccaaaagctcggcaatggcacttcgccctgttgaaacttctgcttcagctccaggaatttactttcaaggataccgcgggcagaaatgcgactggactgcttcgaaacccatgcaccaatctggctatcacgcgggcggctatgaaaatatttcatcacttcgagagtcgaaagtcgttctgctttaccgatcaccatcacctggcgctcaagggtatgccacgggaacagcaggctaacgcgcggattattttcgatttgatgtgctttacggctgccgaggttggtgtaaaacaccatgcctttttcgtcgtaatgtttgagtaaaacgatgcgctgataaggctgaccatgttcatccacggtagcgaccaccatcgcggtagggtccgccagtttggcttcacaagcctgagagagccaacgttcaaaaagggttaatggatcggcgggaagatcgcggcggcgtaacccgcctttggtgtattcacggcgcagatgcgcgatttgctgcaattcgtcgttatcagacatggttttctttacggattgtcagtgggtgacgctattgtgcgccgcccctggaaaaatctcaacgctgtggattttgtaactgacagttattcaagacgatgcggtcgcgtttatagacagtcgcttcatcgcctttcgaccagaaaacatagattccgtcagtgtaacgcgcgccagaggctgaaatgccctgtttgagatgcagtagttgattatcgtaaacaaaactgacctcctggcgcggattattcagtttgaccgtcaacggtttttcatcacactggtattccagcgtatcggtttgcatgcgctcaaccagctgattaaaggcgctacagccggagagaaggaccggcaaaatgataattaacagttttttcatagtcatatcccgaagactttcctggtctggagggcaatacgccctccctaacgttccaagtgtaacggcagacgcggtaagaaaaattcagttaactctgatatcacgggttagcggggaaaatagcccccagtaccgtctcctggcttgcgccagtgacggaaggcagatttcctggtaatcccgccagcgtccgccaggcaagccaggcgaaagccaatgcttccatgtcatcgccactaatgccaacggcatcggtggtggtgacttctgtgcctggcagtaatgccgccagacgcgccatgagtagcggattacgactacctccaccacataccatcaatcgttcgcagccaccgctcaacaaaacttgttcagaaatggtcacggcggtgagttctgccagtgtcgcctgcacatctcggggatcaacacccggaaaatggcgcaaatggcgctccagccaaccatagttaaagtattcgcgtccggtgcttttcggtgcaggttgcgagaaatacgggtcgctgagcatattttgcagcagtgggagaataactttacccgcccgtgcccactcggcatctttatcgtaaggtttaccggcctgacgccagatccaggcatccatcagcatgttaccaggaccggtatcgtagcccccaaccggctgcccaggaatgagcagtgacagattggcgatgccgccaatattgagcaccattcgtcgctcggttgggtgagccagcagcgcatgatggaacgcaggtaccagcggtgcgccttgtcctcccaaggcaatatcgcgacggcgaaaatcaccgacaaccgtaattccggtgcgtgccacaatttgattgttatcgccaatctgtaaagtgtgtggtgccacgcccgtcggttcatgccagacggtttgaccgtgacaaccgatcgcaactatatctcttgcctgcagattttgttccttaagcaaggcattgaccgcatcagcaaaaagttgcccgagttgagtatcaagctgtccaaactgcgaaagtgtaagctgctggccctggcaaatatccagtacagcctgtttcagagataccgggatcggccaactcaaacttgccagctgtgcgacccggtgttcatcaattgtcgccaacacaacatcaacaccatcaaggctggtgcctgacataacgccaataaagcggcccgatttcatagttcatcctttttcaatctgacgtttgcgcaccactcaaacataaacttttcgtgaataccatgcggaatgaccgatttttaccgttggtagtaaaacattatcttcaaatcaataatcatcatgaatgttttgtttataattggttgatcctactttcattatgatttgctcatatttggtagaacatgtaaccatggattcacatatgccatatactttgaccatgagggatgcttgcgtggcgtttcatggtgaacaggagatttttcaatgattaaacgcgtattggttgtttcaatggtaggtctgtctcttgtcggttgtgttaataacgacaccctgtcaggggatgtttataccgcttctgaagcgaaacaagtacagaatgtcagctatggcaccatcgttaacgtacgtccggtacagattcagggcggtgatgattccaacgttatcggtgcaattggcggtgctgttcttggtggtttcctggggaatactgttggtggcggaaccgggcgttctctggctactgcagcaggcgctgttgcaggtggcgtagctggtcagggcgtacagagtgcaatgaacaaaacgcagggtgtcgagctggaaattcgtaaagacgatggtaataccatcatggtggtacagaaacaaggcaacactcgtttctctccgggccaacgtgtcgtactggccagcaatggcagtcaggtgaccgtttctccgcgctaaataagtttgcgtgtggtcaggttactgaccacacgcccccttcatttcaccctttggcctgtaactcaatgatattatgctcaagttttgcgatgagcgtaatcagttgctccagttcctctgcggagatgccatgtaatatttccgcgcgggttttgttaataacagcttccatttcgctgatcagcggctctgccttttccgtcagtttaatacgtttagcccgacgatcgctggcacaagtttgacgcgaaattaaccctttttcttccagttggtccagagtacggaccagtgatggctgctcgatgccaatcgcttttgccagttgaatttgcgactggtctggaggtaactgatggatattgtgtaacgtaacccaatgggtttgtgttaactccagcggtttcaggcgatggtctatcagagcacgccatatgcgcaccaaccgtgccagatcagaacctagtggcgattccaatttcatctccttataattagcttgctaagatattatgcggcttttagaatagtgtgcagcaattgtattgctaaaacaaatgtattgctgcatttggttaccgtcagacatatttttcagaaattgcgcgtaaatttttcgcacttaaagaatatttattaatctaacgcaatatattcggtcgtaaaggaatctactttgtgaagtttatgctcaatgcaacaggattgcccttacaagatctggtgttcggtgcgtccgtctactttcctccgtttttcaaagcattcgcgtttggattcgtcatctggcttgtcgtacaccgcctgcttcgtggctggatctacgccggtgacatctggcatcccttgttaatggatttatcgctgtttgcgatttgcgtttgccttgctctggcaatactgattgcgtggtaactatgtcaattaaaacaattaagtatttctcaacaatcattgtagcggtagttgcggttcttgccggatggtggctgtggaattattacatgcaatctccgtggacacgcgacgggaaaatacgcgcagaacaggtttctatcaccccacaggtgtcgggacgtattgttgagctgaatataaaagacaaccagctggttaacgcgggggatcttctgctcacgatcgataaaacgccctttcagatcgccgagctgaacgcacaggctcagctggcgaaagcgcaatctgacctcgcaaaagccaataacgaagcgaatcgtcgtcgtcatctctcacaaaattttatttctgccgaagaactcgataccgctaacctcaatgttaaagcgatgcaggccagtgttgatgccgcacaggcgacgctgaaacaggcacaatggcaactggcgcaaacggaaattcgcgccccggtgagtggatgggtgactaaccttactacccgcatcggcgattacgctgataccgggaaaccgctgtttgcccttgtcgacagccactcgttttacgtcattggttattttgaagaaaccaagttgcgccatatccgcgaaggtgcaccagcacaaattaccctctatagtgataacaaaacgttacagggtcacgtttccagtatcggtcgggcgatttatgatcagagcgttgaaagtgactcaagccttattccggatgttaaacctaacgtcccctgggttcgactcgcccaacgcgttcccgtccgctttgcgctggataaagtcccaggcgatgtcacgttggtgtcgggcaccacctgtagcattgccgtaggtcaataatgaacgcatcgtcatggtccttgcgcaatttgccctggttcagggccacgctggcgcaatggcgttatgcgttacgcaataccattgccatgtgtctggcgctgacggttgcctattatttaaatctggatgaaccctattgggcgatgacctcggctgcagtggttagctttcccaccgttggcggtgttatcagcaaaagcctcggacgcatcgctggcagtttgctcggagccattgcggcactgcttcttgccgggcatacgctcaatgagccgtggttttttctattgagcatgtcggcgtggcttggcttttgtacctgggcctgtgcgcacttcacgaataacgtcgcgtatgcatttcaactggcgggctacacggctgccatcatcgcctttccgatggttaatattactgaggccagccagctgtgggatatcgctcaggcgcgcgtttgcgaggtaatagtcggtattttgtgcggcggcatgatgatgatgatcctgccgagcagttccgatgctactgcccttttaaccgcattgaaaaacatgcacgcccgattactggaacatgccagtttactctggcagcctgaaacaaccgatgccattcgtgcagcacatgaaggggtgattgggcagatactgaccatgaatttgctgcgtatccaggctttctggagccactatcgttttcgccagcaaaacgcgcgccttaatgcgctgctccaccagcaattacgtatgaccagtgtcatctccagcctgcgacgtatgttgctcaactggccctcaccgccaggtgccacacgagaaattctcgaacagttgctgacggcgctcgccagttcgcaaacagatgtttacaccgtcgcacgtattatcgccccgctacgcccgaccaacgtcgccgactatcggcacgtcgccttctggcagcgactacgttatttttgccgcctttatctgcaaagtagtcaggaattacatcgtctgcaaagcggtgtagatgatcataccagactcccacggacatccggcctggctcgtcataccgataacgccgaagctatgtggagcgggctgcgtacattttgtacgttgatgatgattggcgcatggagtattgcttcgcaatgggatgccggtgccaatgcattaacgctggcagcaattagctgcgtactctactccgccgtcgcagcaccgtttaagtcgttgtcacttctgatgcgcacgctggtgttactttcgctattcagctttgtggtcaaatttggtctgatggtccagattagcgatctgtggcaatttttactgtttctctttccactgctggcgacaatgcagcttcttaaattgcagatgccaaaatttgccgcattgtgggggcaactgattgtttttatgggttcttttatcgctgtcactaatcccccggtgtatgattttgctgattttcttaacgataatctggcaaaaatcgttggcgtcgcgttggcgtggttagcgttcgccattctgcgtccaggatcggatgctcgtaaaagccgccgccatattcgcgcgctgcgccgggattttgtcgatcagctaagccgccatccaacactgagtgaaagcgaatttgaatcgctcacttatcatcacgtcagtcagttgagtaacagccaggatgcgctggctcgccgttggttattacgctggggtgtagtgctgctgaactgttctcatgttgtctggcaattgcgcgactgggaatcgcgttccgatccgttatcgcgagtacgggataactgtatttcactgttgcggggagtgatgagtgagcgtggcgttcagcaaaaatcactggcggccacacttgaagaattacagcggatttgcgacagccttgcccgtcatcatcaacctgccgcccgtgagctggcggcaattgtctggcggctgtactgctcgctttcgcaacttgagcaagcaccaccgcaaggtacgctggcctcttaattacttaattacaccacaggcatagcgttcaccgccaccgcccagcggtttaggttgatcggacatattatcgccgccaacgtggaccatcagcgctttgtctttgatttcatccagtgatttcagacgaggcgcgatgacggcatcggtagctttgccgtcattattgacgaccagtgcaggcagatcgcctaaatgcccggcaccttctggcccttcatgtttaccggtattttgtggatcaagatgcccgcctgcggattccgcggcgctggctttgccatctttggtggctggctggcagcttcctttggcatgaatatggaagccatgttcaccggggggtaatgctttcagatcgggcgaaaactccagacctttatcggtttcagtaatggtgacgctaccaattgactgccctaccccttgcgacgtgacgaggttcatctcgactttttcactggcagcttgtgcgccggttgcaacaaccagcgccagaatagccagactaaaacgtttcataggacctccgttcattgtgcattcctgaataagtgtaaaccagtgacacatttttgaacggcggctattcctaaaagtgcttacggtacgtcgtaccccagtgccgctttacggatacgaaaccattgttgacgggtcattttcagtgtttctgcttcgacagctgcccgtacgcgctcaattttacctgaaccgataattggcagcggctgcgatggtaaacgtaatacccaggcgtaaaccacctgttcaatcgagcccgcgtttaactcctctgccaccacagccagttcatcacgcagcggctggaaataatcatcattaaacagacgaccaccaccaaggcaggaccacgccatcggacgaacacgcagttgttgtagttggtcgagcgtgccatccagcagtaacggctgatgcaccggggatatttccacctgattagtggcaagggtaaacggcagacgtgattgcaacagggcaaattgcgcaggcgtaaagttcgatacgccaaaatgacgcactttgccgctctgatgcagatgtttgaacgcgtccgccacttcatcggcatccattaacgggtctggtcggtggattaacagcaaatccagatgatcggtcgcgagattaattagcgactgttcggcgctcttaatgatgtgatcgcggtcagtgatgtaatgaccaatgacgttttcttcacgcgcggtcgtcgcgataccgcatttactgacgatttccatccgttcacgcaggtgaggtgccagtttcagtgcctcgccaaacgccgcttcgcactgatagccaccataaatatcagcatggtccacggtggtcacgccgagatccagatgctcttcaataaaactgaccagctggcgggcggacatattccagtccatcaatcgccagtagcccatcacaaaacgggaaaactccgggccttgcggcgcaatagtaatacgctgaaccataatcgcttcctcttatcagatatgagaggagtatacgcaagattaggttcaaaagagtgatggttgctccggttcgtctgatgacgctggcttatttgcgcgtaatttgcgcattaatcgctgccgacaaaggcgcagcacctcttgtttttcgccatcgctcattttattccagttaaaacgctcatcacgactacgaaaacagccgcgacaaaacccgcgttcgtcagactggcaaattccccggcacgggctctggacgggaaagaactctaattgctccgccacttcgccctcctcagataagattattaccattattgaagctgttaatgtccaaagtagcaactttgcttgcactagaccgactggtctactacactccaacgcatgaacaaacacaccgaacatgatactcgcgaacatctcctggcgacgggcgagcaactttgcctgcaacgtggattcaccgggatggggctaagcgaattactaaaaaccgctgaagtgccgaaagggtccttctatcactactttcgctctaaagaagcgtttggcgttgccatgcttgagcgtcattacgccgcatatcaccagcgactgactgagttgctgcaatccggcgaaggtaactaccgcgaccgcatactggcttattaccagcaaacactgaaccagttttgccaacatggaaccatcagtggttgcctgacagtaaaactctctgccgaagtgtgcgatctgtcagaagatatgcgcagcgcgatggataaaggtgctcgcggcgtgatcgccctgctctctcaggcgctggaaaatggccgtgagaaccattgtttaaccttttgtggcgaaccgctgcaacaggcacaagtgctttacgcactgtggcttggcgcgaatctgcaggccaaaatttcgcgcagtttcgagccactggaaaacgcgctggcccatgtaaaaaacattattgcgacgcctgccgtttagcaggcattttttatcaccagacgaccgggagcctttatgtcatctgaaaaactgtattccccactgaaagtgggcgcgatcacggcggcaaaccgtatttttatggcaccgctgacgcgtctgcgcagtattgaaccgggtgacattcctaccccgttgatggcggaatactatcgccaacgtgccagtgccggtttgattattagtgaagccacgcaaatttctgcccaggcaaaaggatatgcaggtgcgcctggcatccatagtccggagcaaattgccgcatggaaaaaaatcaccgctggcgttcatgctgaaaatggtcatatggccgtgcagctgtggcacaccggacgcatttctcacgccagcctgcaacctggcggtcaggcaccggtagcgccttcagcacttagcgcgggaacacgtacttctctgcgcgatgaaaatggtcaggcgatccgtgttgaaacatccatgccgcgtgcgcttgaactggaagagattccaggtatcgtcaatgatttccgtcaggccattgctaacgcgcgtgaagccggttttgatctggtagagctccactctgctcacggttatttgctgcatcagttcctttctccttcttcaaaccatcgtaccgatcagtacggcggcagcgtggaaaatcgcgcacgtttggtactggaagtggtcgatgccgggattgaagaatggggtgccgatcgcattggcattcgcgtttcaccaatcggtactttccagaacacagataacggcccgaatgaagaagccgatgcactgtatctgattgaacaactgggtaaacgcggcattgcttatctgcatatgtcagaaccagattgggcggggggtgaaccgtatactgatgcgttccgcgaaaaagtacgcgcccgtttccacggtccgattatcggcgcaggtgcatacacagtagaaaaagctgaaacgctgatcggcaaagggttaattgatgcggtggcatttggtcgtgactggattgcgaacccggatctggtcgcccgcttgcagcgcaaagctgagcttaacccacagcgtgccgaaagtttctacggtggcggcgcggaaggctataccgattacccgacgttgtaatccaacattgcgagcggcgtaaagccgccgctatactaaaacaacattttgaatctgttagccattttgaggataaaaagatgcgtcttcttcataccatgctgcgcgttggcgatttgcaacgctccatcgatttttataccaaagtgctgggcatgaaactgctgcgtaccagcgaaaacccggaatacaaatactcactggcgtttgttggctacggcccggaaaccgaagaagcggtgattgaactgacctacaactggggcgtggataaatacgaactcggcactgcttatggtcacatcgcgcttagcgtagataacgccgctgaagcgtgcgaaaaaatccgtcaaaacgggggtaacgtgacccgtgaagcgggtccggtaaaaggcggtactacggttatcgcgtttgtggaagatccggacggttacaaaattgagttaatcgaagagaaagacgccggtcgcggtctgggcaactaatctcctgccgggcgtgaactcatcgcgcccgcatctttactgcatcgacaagtaatatttgtcataatgcgcgctgcaatttatccgtattaagagaatcagatgtccgataacgctcaacttaccggtctgtgcgaccgttttcgtggtttttatcctgttgtgatcgatgttgaaacagccggatttaacgccaaaaccgatgcgctgcttgagattgccgccatcaccctgaaaatggatgaacaaggctggctgatgccggacaccacattacatttccacgtcgaaccatttgtcggcgcaaatttgcaaccagaagccctcgccttcaacggcattgacccgaacgatcccgatcgcggcgcggtcagcgaatacgaggcgctgcacgaaatttttaaagttgtacgtaaaggtattaaagcgagcggctgtaaccgcgccattatggtggcgcacaatgccaattttgatcacagctttatgatggccgccgcagaacgcgcctcactgaaacgtaacccgttccaccctttcgccacttttgacactgctgcactggccgggctggcactcggacaaaccgtattgtcaaaggcttgccagaccgctggcatggacttcgacagcacccaggcgcactccgcgctgtacgacaccgaacgcactgctgtgctgttttgtgaaatcgtcaaccgctggaaacgtctgggaggctggccgctatctgccgccgaagaggtgtaatcgagtcgatgcctgatgacatgcaatgattcaggcatctatagtgaggctattccacgcatcctgcatgatattcacggggaatagcgttaatggcagataatccagacccttcatcgctcctgccggacgtgttttcaccggcgacccgcgactggtttcttcgcgcctttaaacagccgaccgctgtccagccgcaaacctggcatgtggcggcgcgaagcgaacatgcgctggtgattgcaccgaccggctccgggaaaacgctggcagcatttctctacgccctcgatcggctcttccgcgaaggcggcgaagatacccgcgaggcgcataagcgtaaaacctcacgcatcctctatatttcaccgataaaagccctgggcaccgacgttcagcgcaacttgcagatcccgttgaagggtattgccgatgaacggcggcggcgcggcgaaacggaagtcaatcttcgcgtagggatccgtactggcgatacgcctgcacaggaacgcagcaaactcacccgtaatccgccggatattctgatcaccacacccgaatcactctatctgatgctgacctcccgcgcgcgcgaaacgctacgcggcgtcgaaacggtaattattgatgaagtccacgcggtagcgggcagtaaacgtggtgcgcatctggcgttaagtctggagcggctcgatgcgctgctccacacctcagcacagcgaattggcctttctgccactgtgcgctcagccagcgatgtggcagcatttcttggtggcgatcgcccggttacggtagtcaacccgcccgcaatgcgccatccgcagatacgaattgtcgtaccggtcgccaatatggatgatgtctcatcggtcgccagcggcaccggcgaagacagccatgccggccgggaaggctccatctggccatatattgaaacgggtatccttgatgaagtgttgcgccatcgctcgaccattgtctttactaattcgcgggggctggcggaaaaactgacggcacgattaaatgagctttacgccgcacgcttacagcgttccccgtctatcgccgttgatgcggcccatttcgagtcgacctccggcgcaacctctaaccgtgtacaaagtagcgacgtttttattgcccgctcacaccacggctccgtctctaaagaacaacgagcaatcaccgaacaggcgctgaaatcgggtgaattacgctgcgtggtcgcaacctccagtcttgaactggggattgatatgggcgcggtggatctggtgattcaggtggcaacgccgctttctgttgccagtgggttacaacgcattggtcgcgccggacatcaggttggcggtgtatctaaagggctgtttttcccccgtacccggcgtgatttagtcgattccgcagtcattgtagagtgtatgttcgcaggcaggctggaaaacctgacaccaccgcataatcctctcgacgtccttgcgcagcaaaccgttgccgccgcggcgatggatgcattacaggtagacgaatggtactcccgcgtacgccgtgccgcaccgtggaaagatctgccaagacgtgtttttgacgccacgctggatatgctttccgggcgctatccctctggcgatttttctgcttttcgccccaaactggtctggaacagggagaccgggatattgaccgcccgacctggcgctcaattgttggcggttaccagcggcggcaccattccggatcgtggcatgtatagcgtgttattacccgaaggtgaagaaaaggccggttcgcggcgggtgggtgaactggatgaggagatggtatatgagtcgcgggtgaacgacattatcactctcggcgctacctcatggcggatccagcaaatcacccgcgatcaggtgattgtgactcctgctccgggtcgttctgcccggctccccttctggcgtggtgaaggtaacggacgtccggctgaattaggcgagatgatcggcgattttcttcatttgctggcggatggcgcgttcttttccgggactattcccccgtggctggcagaagaaaatacgatcgccaatattcaggggttgattgaggagcagcgcaacgcgacgggcatcgttccggggagtcgccatctggtcctcgaacggtgccgtgatgaaattggtgactggcgtattattttgcactctccctatggaagacgggtgcatgaaccctgggcggtggcgattgccgggcgaatacatgcgctatggggcgctgacgcgtcggtggtcgccagtgatgacggcattgttgcacgtattcctgacaccgatggtaaattgcccgatgccgcgatttttttgtttgaaccagaaaagttgctgcaaattgtccgcgaggcggtaggcagctcggcacttttcgccgcccgttttcgcgaatgcgccgcgcgggcattattaatgccggggcgcactccgggccatcgcaccccgctttggcaacaacggctgcgcgccagtcagttgctggaaatcgctcagggatatccggattttccggtcattctcgaaaccctacgcgaatgtctgcaagatgtttatgatcttcccgcactggaacgtttgatgcgtcgcctgaacggtggcgaaattcaaatatccgatgtaacgaccactacgccctcgcctttcgccacaagtttattgttcggctatgtcgcggaatttatgtaccagagcgacgccccgctggcagagcgccgggcatccgtactgtcgctggacagcgagttactgcgcaatctactcggacaggtcgatccgggggaattactcgacccgcaggtcattcgccaggtggaagaagagttgcaacgactggctcctggcagaagagcgaaaggtgaagaaggattgttcgacctgctgcgcgaactggggccaatgaccgttgaagacctggcgcaacggcatacaggcagcagtgaagaggttgcgtcgtatctggaaaatcttcttgcagtaaaacgaatcttcccagcgatgattagcggacaggagcgtcttgcctgtatggatgatgccgccaggctgcgtgatgccctcggcgtacgactaccagagtcattgccagagatttatttacatagagtcagttacccgcttcgcgacctctttctgcgctatctccgggctcatgctctggtcacggctgaacaactggctcatgagtttagtctcggtattgccattgtcgaagagcagcttcagcaactgcgtgaacagggtctggtgatgaatctgcaacaagacatctgggtgagcgatgaagtatttcgtcgtctgcgtttgcgctcgctgcaagccgccagagaagcgacgcgtcccgttgcagccacgacctatgcgcgattgctgctggaacgtcagggcgtattacccgccaccgatggtagcccggcgctctttgcctcaacatcgccaggcgtttatgagggcgtagatggcgtgatgcgggtgatcgaacagcttgccggagtcggtttacccgcctcactctgggaaagccagatcctgcctgcccgcgtacgcgactattcgtcagaaatgctcgatgaattactggcaaccggtgcggttatctggtcggggcaaaaaaaactgggtgaagatgacggcctggtggcactgcatctacaggaatatgctgcagaatcgttcactcccgccgaagcggatcaggcgaatcgttcggcgctgcaacaagcgatagtcgctgttctggctgacggaggagcctggtttgcacaacaaatcagccaacggatacgcgacaaaatcggcgaatcggttgatctctctgccctgcaagaggcgttatgggcgctggtctggcaaggcgtcatcaccagcgacatttgggcaccgttacgcgccctcacccgcagcagttccaacgcacgcacctcaactcgccgcagtcaccgggctcgtcgtggacgtcctgtctatgcgcaacccgtctcgccgcgggtatcttacaacacaccaaatctggctggacgctggtcgttattgcaggtggagccactaaacgataccgaaaggatgctggcgctggcggaaaatatgctcgaccgctacggcatcatcagtcgtcaggcggtgatagccgaaaatatccctggcgggtttccatcgatgcaaacgctttgtcgaagtatggaagactccgggcgaattatgcgaggtcgttttgtagaaggtctgggtggcgcgcaattcgctgaacgtctgactattgaccgattgcgcgatctggcgacacaagccacgcaaacgcgccactatacaccagtggcgctctctgccaacgatccggctaatgtgtggggaaatcttctgccctggcctgcacatccggcaacgctggttccaacgcgtcgggcgggtgcgctggtggtcgtttctggcggcaaattgttactctatctggcgcaaggtggcaaaaaaatgctggtctggcaggaaaaagaggaattactcgccccagaggttttccacgcgctgactaccgcactgcgtcgcgaaccacggctgcgctttacgctaacagaagtgaatgatctaccggtccggcaaacgccgatgtttacgctgctgcgtgaggcgggattttcaagttcgccacaagggctggattggggatagagaaaggactgacggatgcccgttcgcatccgtcagtattgcaggacggattattccgcgtccggctcttcagacttgtatttagcggcagtttctttgatcagctgctgcagttcgccacgctgatacatttcgatcacgatatcacaaccgccgaccagctcgccgtcaacccacagttgcgggaaggtcggccagttagcatatttcggcagttccgcacgaatgtccggattctgcagaatatcaacataggcaaaacgttcgccacatgcggcaagcgcctggactgcctgggcagagaaaccgcagctcggcagtttcggtgaacctttcatgtacagcaggatcgggttttcagcaatctggcgttggattttttcgatagtggtgctcattgtcttgcttcctcaaacttctttacggcagtaatctgacattgtagcgggtcagtgcggcatcggaaaataacattttcatcacgcttttgctattttatccctttgctctatttgttgcatttcaaatattcgtttcttctctgatgccggcaaactggcgtatttataaccatttttagctttcactgctgcatttttttgcgctcgccaacgaaacgtattttttaacaataaaagctattaactttctcttcttctatgcattagaatcatcaagttttgtaaatcagacgcaggcatgatagacctgcctttacagagggacgctcagtggcgcggataaaccgtatttcgatcacgctctgtgctttactttttaccaccctgcctttaacgcctatggcccatgcttcaaagcaagccagggagagttctgctaccactcatatcaccaaaaaagcagataaaaagaaaagcacggcaaccaccaaaaagacccagaaaacagcgaaaaaagccgccagtaaaagtacgaccaaaagcaaaaccgcttcttccgttaaaaaatcttccattaccgcttctaaaaacgccaaaactcgcagcaaacacgccgtcaataaaacggcctcagccagctttaccgaaaagtgtaccaaacgtaagggctataaatcgcattgtgtgaaagtcaaaaatgccgcgtcaggaactcttgccgacgcgcacaaagcgaaggtgcaaaaagctacgaaagtggcaatgaataaactgatgcagcaaattggtaagccatatcgttggggtggcagctcaccgcgtaccggttttgattgcagcggcctggtttattacgcttataaagatttggtgaaaattcgtattccgcgtacggcgaatgaaatgtatcacctgcgtgatgcagcgccaatcgaacgtagtgaactgaaaaacggcgacctggtctttttccgtactcagggacgcggcacagccgatcatgtcggcgtgtatgtcggcaacggcaaatttattcagtcaccgcgcacaggtcaggaaattcaaatcacttctctcagtgaagactactggcagcgccactatgttggcgctcgtcgggtaatgaccccaaaaacacttcgctaaaactttaccctgttgttacggcaacagggtaagttcatcttttgtctcaccttttaatttgctaccctatccatacgcacaataaggctattgtacgtatgcaaattaataataaaggagagtagcaatgtcattcgaattacctgcactaccatatgctaaagatgctctggcaccgcacatttctgcggaaaccatcgagtatcactacggcaagcaccatcagacttatgtcactaacctgaacaacctgattaaaggtaccgcgtttgaaggtaaatcactggaagagattattcgcagctctgaaggtggcgtattcaacaacgcagctcaggtctggaaccatactttctactggaactgcctggcaccgaacgccggtggcgaaccgactggaaaagtcgctgaagctatcgccgcatcttttggcagctttgccgatttcaaagcgcagtttactgatgcagcgatcaaaaactttggttctggctggacctggctggtgaaaaacagcgatggcaaactggctatcgtttcaacctctaacgcgggtactccgctgaccaccgatgcgactccgctgctgaccgttgatgtctgggaacacgcttattacatcgactatcgcaatgcacgtcctggctatctggagcacttctgggcgctggtgaactgggaattcgtagcgaaaaatctcgctgcataataactgatggcaaatgcagcattgcctgaagcgctacgcttatcaggcctacgcggatcatcgatgtaggtcggataaggcactcgccgcatccggcaagataaatcgcacgttgtcagcaactgtaacgcagaaggttatccttctgcgtttttgtttaattagctgttagcaacgcaaactgtttcaggttgttttctggctgacataaacaccagcaataatgccagtcccgcgacaatcgctcccatcaccggcacaaagctgtatcccagcccagcggaaattaccgcaccaccagcagctgctcccagcgcatttccaagattaaaggcaccaatattgactgatgaagacagacctggcgcttcactggcgacacgcatcacgcgcatctgtaacggcggtacgaccgcaaaggttgctgcgccccacaccaccatgctaatagctgcgccgaactcattgcgggccaggaacgggattgccagcataatcaccatcaacaacaacaaaaagcctttcaacgtgccgttaactgaacgatctgccagtttgccgccgagatagttaccgatagagaatccgacaccaatcagcaccagcattgccgtgacgaacaccggtgttgcgtgggtaatactttgcagtaccggagagatataggtgtagagagtaaacattgcaccagctcccagtaccgtcgtcagcaatgcagacagcacctgcggacgcattaataccgccagctcttttttcacttcaggtcgtgcccctgcaccacctttaggtaatgagaagaacagacttaccattgaaatcactcccagccccgccgttgccagaaatgacatccgccagccgatggtttcacccaaccaggtcgccgccggcacgccaccgatatttgccagggttaaccccataaacatagtggcaactgcgctggcctgtttatgttttggcaccacgcttgcggccacgactgaacccaaaccaaaaaatgctccgtgattcaggctggtcaaaatgcgtgaaagcatcagggtcatataatccggcgcgatggcggaaagtacgttgccgagcgtgaaaattgccatcaggaaaatcaacgcactgcggcgggcacgatgagaaagtagaagcgtcatcagcggcgcgccaaccattacgccaactgcataggcactgattaacattccggcagcgggaatcgagacatccacaccgcgcgcaatgacgggcaacaagcccattggcgagaactccgttgtcccgataccaaacgcgccaatcgccagcgccagcaacggatagttaattttcatgccttatctccacctcttcgcgtcattacgcgatattcattaaagtggcgaaagcatgacagcaatcacaaaaaaatgaaaataacaaaaagagaaaacacttttgccattttgctaacaaacaggaaggagatgcgagggagaacgcgctccctcgagaggaaatcagtgcagcgcggcagtcaaacccacggctacgatcaaaccgaggacgataatcgttgttaccagtgaaaatttaaggtcggtgctcatcaagttttctccttttttattaccacacaaaaagtgatattacgcatttttacacactgtgatgaaaaaatctcccgtcatttataatgataagtgtttttaccacttccccttttcgtcaagatcggccaaaattccacgcttacactatttgcgtactggccattgaccccttcctgacgctccgtgtcgtttttccggcgtaccgcaacacttttgttgtgcgtaaggtgtgtaaaggcaaacgtttaccttgcgattttgcaggagctgaagttagggtctggagtgaaatggaatggcaacaataaaagatgtagcgaaacgagcaaacgtttccactacaactgtgtcacacgtgatcaacaaaacacgtttcgtcgctgaagaaacgcgcaacgccgtgtgggcagcgattaaagaattacactactcccctagcgcggtggcgcgtagcctgaaggttaaccacaccaagtctatcggtttgctggcgaccagcagcgaagcggcctattttgccgagatcattgaagcagttgaaaaaaattgcttccagaaaggttacaccctgattctgggcaatgcgtggaacaatcttgagaaacagcgggcttatctgtcgatgatggcgcaaaaacgcgtcgatggtctgctggtgatgtgttctgagtacccagagccgttgctggcgatgctggaagagtatcgccatatcccaatggtggtcatggactggggtgaagcaaaagctgacttcaccgatgcggtcattgataacgcgttcgaaggcggctacatggccgggcgttatctgattgaacgcggtcaccgcgaaatcggcgtcatccccggcccgctggaacgtaacaccggcgcaggccgccttgccggttttatgaaggcgatggaagaagcgatgatcaaggtgccggaaagctggattgtgcagggtgactttgaacctgaatccggttatcgcgccatgcagcaaatcctgtcgcagccgcatcgccctactgccgtcttctgtggtggcgatatcatggcaatgggcgcactttgtgctgctgatgaaatgggcctgcgcgtcccgcaggatgtttcgctgatcggttatgataacgtgcgcaacgcgcgctattttacgccggcgctgaccacgatccatcagccaaaagattcgctgggtgaaacagcgttcaacatgctgttggatcgtatcgtcaacaaacgtgaagaaccgcagtctattgaagtgcatccgcgcttgattgaacgccgctccgtggctgacggcccgttccgcgactatcgtcgttaatcacccgttgcgggagtctcttccggctcccgcagccactccttattcagcgtctcactatcgccgagatactcaagcaaccaggttaacgcaggcgacatatcattttgctgccatgtcagacaacatgccgaatccggaaaggggttttccagttctaatgctacccacttcccctcattaagccacggtttggcgaaatgtgttggcaccatccctatgcataatcctgccgagatacaggttgccgatgattcccagtcaggcacgacaactcttttttggttatccagcaaccaggtaatacgtttaggtagcgttcgcgaggtgtcttcgcgcaccaacgacggccagttgcgcaacgtatcatcgctgaacgggccatccatcaacgccagcgggtggtgactggcaacaacgcaactccagcttagcatccccatatcccggaaggcataacgaccgcctaccggaatcgcgcgtgttgcgccaatcgccagttccacgcgcccgtcggaaagcgcatcccagacaccgttgaacacttcctgaaagacaagaagttcgacatcatcaaaatggcgataaaaatcaacgatcatctgccgtgtacgttctggcctgacaatattatccactgcgatagctaactgaccgcgccagccgttcgctatctgctgacattgctggcgggtgatctgcatttttttgacaacagagcgcccttctttgagaaaccacgctccagcagcggtcagctccacatcacggtgccgtcgttcaaagagcggcaccgccagccactcttccagctgacgcacggtatagctgaccgcagaaggaacgcgatgcagctcctgtgccgcagcgctaaaactaccattacgcgctaccgcatcaacaacttcgagtgaatattctgaccacatagtctgcctgcaaaatttttgaaaccagtcatcaaatattaccgtttcacaacactaatttcactccctacactttgcggcggtgtttaattgagagatttagagaatatacatgcaacctgggaaaagatttttagtctggctggcgggtttgagcgtactcggttttctggcaaccgatatgtatctgcctgctttcgccgccatacaggccgacctgcaaacgcctgcgtctgctgtcagtgccagccttagtctgttccttgccggttttgccgcagcccagcttctgtgggggccgctctccgaccgttatggtcgtaaaccggtattattaatcggcctgacaatttttgcgttaggtagtctggggatgctgtgggtagaaaacgccgctacgctgctggtattgcgttttgtacaggctgtgggtgtctgcgccgcggcggttatctggcaagcattagtgacagattattatccttcacagaaagttaaccgtatttttgcggccatcatgccgctggtgggtctatctccggcactggctcctctgttaggaagctggctgctggtccatttttcctggcaggcgattttcgccaccctgtttgccattaccgtggtgctgattctgcctattttctggctcaaacccacgacgaaggcccgtaacaatagtcaggatggtctgacctttaccgacctgctacgttctaaaacctatcgcggcaacgtgctgatatacgcagcctgttcagccagtttttttgcatggctgaccggttcaccgttcatccttagtgaaatgggctacagcccggcagttattggtttaagttatgtcccgcaaactatcgcgtttctgattggtggttatggctgtcgcgccgcgctgcagaaatggcaaggcaagcagttattaccgtggttgctggtgctgtttgctgtcagcgtcattgcgacctgggctgcgggcttcattagccatgtgtcgctggtcgaaatcctgatcccattctgtgtgatggcgattgccaatggcgcgatctaccctattgttgtcgcccaggcgctgcgtcccttcccacacgcaactggtcgcgccgcagcgttgcagaacactcttcaactgggtctgtgcttcctcgcaagtctggtagtttcctggctgatcagtatcagcacgccattgctcaccaccaccagcgtgatgttatcaacagtagtgctggtcgcgctgggttacatgatgcaacgttgtgaagaagttggctgccagaatcatggcaatgccgaagtcgctcatagcgaatcacactgatctatatcgatatacttatacttaggctgctaacaaaattttgttgtatgattgaaattagcggcctatactaatttcgagttgttaaagctacgataaatattatgtttttacggggacaggatcgttcccgactcactatggatagtcatttcggcaagggttcctcctttccctctgttctacgtcggattatagactcgcggttttttctgcgagatttctcacaaagcccaaaaagcgtctacgctgttttaaggttctgatcaccgaccagtgatggagaaactatgagttcatcgtgtatagaagaagtcagtgtaccggatgacaactggtaccgtatcgccaacgaattacttagccgtgccggtatagccattaacggttctgccccggcggatattcgtgtgaaaaaccccgatttttttaaacgcgttctgcaagaaggctctttggggttaggcgaaagttatatggatggctggtgggaatgtgaccgactggatatgttttttagcaaagtcttacgcgcaggtctcgagaaccaactcccccatcatttcaaagacacgctgcgtattgccggcgctcgtctcttcaatctgcagagtaaaaaacgtgcctggatagtcggcaaagagcattacgatttgggtaatgacttgttcagccgcatgcttgatcccttcatgcaatattcctgcgcttactggaaagatgccgataatctggaatctgcccagcaggcgaagctcaaaatgatttgtgaaaaattgcagttaaaaccagggatgcgcgtactggatattggctgcggctggggcggactggcacactacatggcatctaattatgacgtaagcgtggtgggcgtcaccatttctgccgaacagcaaaaaatggctcaggaacgctgtgaaggcctggatgtcaccattttgctgcaagattatcgtgacctgaacgaccagtttgatcgtattgtttctgtggggatgttcgagcacgtcggaccgaaaaattacgatacctattttgcggtggtggatcgtaatttgaaaccggaaggcatattcctgctccatactatcggttcgaaaaaaaccgatctgaatgttgatccctggattaataaatatatttttccgaacggttgcctgccctctgtacgccagattgctcagtccagcgaaccccactttgtgatggaagactggcataacttcggtgctgattacgatactacgttgatggcgtggtatgaacgattcctcgccgcatggccagaaattgcggataactatagtgaacgctttaaacgaatgtttacctattatctgaatgcctgtgcaggtgctttccgcgcccgtgatattcagctctggcaggtcgtgttctcacgcggtgttgaaaacggccttcgagtggctcgctaaaggctattctatcgccccctctccgggggcgatttcagatcaggcttctgtgcctggttgattcatggcattttctcgtgccgccagcacacgttctaccgtatctaccactgcctgagtttgtggatcgatttcaatgttgacgcgtgcgccaagttttttcttcccaagagtcgtgcgttccagtgtttccggaattaaatggacgcaaaaacgcgttggcgtgacttcgccgacggtcaggctaataccgtcgatgccaataaatcctttgtacagaatatatttcatcaactgactatcctggactttaaaccagatctggcgattattttctgaggttaatattttcgccacttcagcagtggtcataatatgacctgacattaagtgtccgccaatttcatcactgaatttcgccgcacgctcaacgtttacccaatcccccacttttaaatcgccaagattggtaatgcgtaacgtttctttcatcaggtcaaaactgacatggttgccgttaatttccgtcacggtcaggcagcaaccgttatgcgccacggaagcaccggtttccaggccgtccagcatgtggtcgggtaactccaccacatgcgtacgaaaatttggtttctcgtcaatcgacaccagttttgcggtgccctgtacaatccccgtaaacatacttacaactcctgaaatcagttaagacattctgttcagcacaatagcaggtggaaaacgcccttaccagtgaaggggtaagaatggctattttttcactggagaattaataaatcctcgctacaatagactgaatttcccctgcttcttctttttgctgcccattcaggcggctttttagtctctcatataactacaaataaaaggtgttcacgtgcagaagtatatcagtgaagcgcgtctgttattagcattagcaatcccggtgattctcgcgcaaatcgcccaaactgcgatgggttttgtcgataccgtgatggcgggcggctatagtgccaccgacatggcggcggtcgctatcggtacttctatctggcttccggcgatcctctttggtcacggactgctgctggcattaacgccggttatcgcgcaattaaatggttccggtcgacgtgagcgcattgcgcatcaggtgcgacaaggtttctggctggcaggttttgtttccgttctcattatgctggtgctgtggaatgcaggttacattatccgctccatggaaaacatcgatccggctctggcggacaaagccgtgggttatctgcgtgcgttgttgtggggcgcgccgggatatctgttcttccaggttgcccgtaaccagtgtgaaggtctggcaaaaaccaagccgggtatggtaatgggctttatcggcctgctggtgaacatcccggtgaactatatctttatttatggtcatttcggtatgcctgagctcggtggcgttggttgtggcgtggctactgcggcggtgtattgggtcatgttccttgccatggtttcttacattaaacgcgcccgctccatgcgcgatattcgtaacgaaaaaggcaccgcaaaacccgatcctgcggttatgaaacgactgattcaactcggtttgccgattgcgctggcactgttctttgaagtgacactgtttgccgtcgtggctctgttagtgtctccgctcggtattgttgatgtcgcaggacaccagattgccctgaactttagttcactaatgttcgtgcttccaatgtcgctggcggcagcggtaactatccgcgtaggttatcgtctgggtcagggctcaacgctggatgcgcaaaccgctgcgcggaccgggcttatggtgggtgtctgtatggcaaccctgacggccattttcacggtttcactgcgggagcaaatcgccctgttgtacaacgacaatcccgaggttgtaacgctggctgcgcatttgatgttgctggcggcggtatatcagatttctgactcaatccaggtgattggcagtgggattttgcgtggttataaagatacgcgttccattttctatattacctttacggcttactgggtgctgggcttgccaagcggctatattctggcactgaccgatctggtcgttgaacctatggggccagcaggcttctggataggctttattattggcctgacgtcggcagccattatgatgatgttgcgtatgcggttcctgcaacgtctgccgtcagccatcattctgcaacgagcatcccgctaataaagacaaggcgcaaccttcacgggttgcgcctgtatttttacgcaggctggagcgttgcgccaatcccgtcttcgtctggctgtaatttcagagcgttacacagagtttgccgactggcatctgttatctcaacgtgtatatccccggtaacttcccctttcacattgatgaagtcaggtgaaatttcttttgcactggtttgcaggcaaatcgctccctctccgcgcaggcgtttcactttcagttgcacatgcgttgccgcatcagtgatcagccacagttttccaccattcagattgatgttaccaacaatgaaagtgacactgtcaccttttaccgtactgccgtctagaatcaacacaccgccctgctgtacagtaatcgttgattgttgcagctctgcgccataaccaataatcattgaagcgccgtccagtaatgcaacactcccggtcagttcaaccggtgcgcgatcttcctctacgacaaaattttcgtccgcgctggtgggtgacaacaggatcactgtcccaccttgtattaccgcgttttccagcgtaccggcatgcacttcagcccgaccacccacattcacggacaggttttgcgtcttaccggaactgtagagctgaaggccatccgtccccagacgataaatggatccattctcaacaatagtgtcagagtcttcaccaccgagattattcatggtgccaccagcaagcaacgtatcactggctttcccggccagcataaaaacgccgccctgattaatctcacaattgctggcttccccacctggatacaccaacaattcaccaccttcatctaccacgaccgctgaggttgtcccattaaccaacaggccgccctcttgatcgagaatgattttttccgcgcgatgtccttccagtacacgcaggttaccgccattttccagcaacaaaccgcaggcataacctttatcaacgctgaattcaccttcgggatggcggccattaaccgtagcgagcgtagagagactaattgcgcctccctcggactgaacaatatctgtggcaatggcaccatcgctgaccgatagcgtgccattgttaccgtactgtgtgcatttggcgatcccaccggttgccactttcaaccagccagcccccgtgaccacggtattttcggctcttccgccagcttcaacaatcaactcgccttcagtaagttgcgtcgcgccaatgacctcgccggtcttaacaatttgcacgttcccgtcgctcatcaagtttttcgcatcagatcccatgatttattcctttgctgcatctgtgtgcctttattgctacctaagtgtaaaggctacggaggatttatccacgacagatttgagatggtggcaaacaactctgtttaaactctgatacacgaattattgggttgtatcagatgtaaatgcgatcctgaataaaaatcacccttgcaaatcaacaaaatatagccaatttgcttaaaagctctgcaaacggtcgaaatagcgcagaaaattacgttttgcctcttgccaccttcccactctgccgctaatattcgtccccgttgtcacctacaacgttgcgttcatagctcagttggttagagcaccaccttgacatggtgggggtcgttggttcgagtccaattgaacgcaccatcctgcgtccgtagctcagttggttagagcaccaccttgacatggtgggggtcggtggttcgagtccactcggacgcaccagattttcttaatctggtcttctcctttttccctctgtttcttctctgtatccaatacgttaaaagatttacactgtcttcgtatgcgttatcagaaggagaatcgctatggcaactttgttacaacttcattttgcttttaatggcccatttggcgacgcaatggctgagcagcttaaaccacttgctgagtcgattaatcaggaacctggttttctgtggaaggtatggacagaaagtgaaaagaaccacgaagccggtgggatctaccttttcactgatgaaaaaagcgcccttgcctatctggaaaaacatactgcccgactgaaaaatctcggcgttgaggaagttgtcgccaaagttttcgatgtcaatgagccacttagtcaaatcaatcaggcaaaactcgcctgacagaatttaatcaagggcggttagcgcccttttcatccctgtctgaaatttctcaaattctaaaaatctcaaccaaacttatctgataacactaaattcgaaagaatgcgtacaggtaagtaacaatgaaaaaaattgctattgtgggtgccgggcctacggggatctacaccttattctcgcttctacagcaacaaactccactttctatttctatcttcgagcaggctgacgaggccggtgtcgggatgccatacagtgatgaggaaaactcaaaaatgatgctggcaaatattgccagtattgaaataccgccgatttattgtacgtatctcgaatggctacaaaagcaagaagacagccatctccagcgttatggcgttaaaaaagaaaccttgcacgatcgtcagtttttaccgcgaattctgctgggcgaatatttccgcgatcaatttttacgactagtagaccaggcacgacagcaaaaatttgcagtggctgtttatgaatcatgccaggttaccgatctgcaaattacaaatgctggcgtcatgctcgctacaaatcaggatttacccagcgagacgtttgatttagcggtgatcgccacgggtcacgtctggcctgatgaagaagaagcaacccgaacgtattttcccagcccgtggtcaggcctgatggaagcaaaggtcgatgcgtgtaacgtgggtattatgggaacatccttgagcggactggatgcggcaatggcagtggctattcagcatggttcgttcattgaagatgataaacaacacgtcgtttttcaccgcgataacgcaagtgaaaagctaaatatcacgttgttgtcgcgcacgggtattttacccgaagccgatttctattgccctattccctacgagcccttacacatcgtcaccgatcaggcattaaatgctgagattcaaaaaggcgaagagggccttttggatcgggtatttagattgatagtagaggaaatcaagtttgctgatccagactggagtcaacgcatagccttagagagcctgaatgtcgattcctttgctcaagcctggtttgccgagcgcaaacaacgcgacccatttgactgggcagaaaaaaatctccaggaagtcgaacgcaataaacgagaaaaacatactgttccctggcgttatgtcattctgcgcctgcatgaagccgtacaggaaattgttccacatctgaatgaacacgaccataaacggttcagtaaaggccttgcccgggttttcatcgataattatgcggcaatcccttcagagtctattcgtcgcctacttgccttacgtgaagcgggaatcattcatattctcgccctcggtgaagactacaaaatggaaattaatgagtcgcgcaccgtcctgaaaacggaagacaacagctactcgtttgacgtttttattgatgcccgcggacaacgtccgcttaaagtgaaagatatccctttccctgggctacgcgagcaattacagaaaacaggggatgaaatccctgatgttggcgaagattatacgttacagcaacccgaagatattcgtgggcgcgtagcgttcggcgcgttgccctggttgatgcacgaccagcctttcgttcagggacttacggcatgtgcagaaattggtgaggcgatggctcgggcggtcgtaaagcctgcatcccgtgctcgtcggcgtctttcgtttgattaaaggtaaagctatcagcactcaacaaactgatgctgttcattaagacgatagcggactccggctcgaatattgttttcaccttcaatggcgacggcgaagcgaactctttcgccgtcatgatatgccagtgcggcgcttcctcctggcccgagaataattgagtcgaccacgcccgtgctcactaccgttgaattttcaccgctggcaatgatgtgtacattgtcgccgctgttggcaattctggcgtttgcgccaaagctggcgatttgcaccaggtcaccattactggcgacatgacaccgttcacccaatgtacaaacgcgtactcgcattccggtattcgcaatccgactgctatctccagcgctgcttatccgcgaagaattaccggttacagcaacccgtgcgcgttcaccggagctgccaatgtgactgttaaagccgacacttccaatccgcacgctataacccatactggcaatttgcgcggcatacccagcggttgcgattctggcgttatcctcacaacagccgatgcgagcatgatcgtcgctgcgggcaaactgactgcaaaatggtctctctccggggtctgtggccagtttttgcatagaggaaacttcctgatgcgcgaagttttcatccgccagccattttttccacgcatactcaaccagactctccgcccagtccgtatatccttcctcaatcagtgcatgatgaatatcggcataactaccgccgcgtgggaaatggcgcaggaaccagcgatacatcaccgctccgatacgccattctcgcaggtctgcttgtgtaatgatcattcgttagtgccggtgatagccatcgaccatgcttttaaaggtttcgtgtggcgtacgccccgtggtgcaaagataaagatgaccgaagataaaaaagaggcttataaatgccagagcaaaatgtgtctgcaataaccagtatcttacgccaggaaacacatctcccacggcttgcggatagagacacagcagccccgtcaatagtaacaacggcagcaatccatacatgacaccaacataggcgacctgctgtaagggattaaatttagactgggttgttgccgggaaaggatgttcttccccctgcataatgccaaacaaataaaatcgcgtttgttttgccgctcgttccagccacccctgacgacgaatgcgatagtggtgaccattatccccaacggcattgatcagcacaaagccgagccagcatgccagtaacaaaaatccgcaaacttcatgcaccgcaaccagacttttaaccgcagttgcgcccaccatcgcaaagtgatttatcagcccactggccagcaacaatacaaagagtaacgcattcgaccagtgccataatctgaccgctttgctgtaaagataaatcttctcaccatgatcggtggctgatttcttcacgccacgagcacgaagcaaggcatgcagccccagcaccaaccacatcccaaccagcaatactccggcaatgatcaaccacaccggccaaaattcgggagtgaactgtggcacatagttcgctaactggctctgaaactgttcagcatgttgcgacgggttcatacattttcctttttaatcaaatgttgaccgaaccggcgatacagatgcggtttcccggcaccaggtagctgatattgatagtatttattttgctgcaaccacgcctgaatttctgggctatcttcgcgaccaaagatcaatgcgtgttccgggcaggcgctgacgcaaatgggcggaaagccttttgccagtcgggactcagcgcagaaatcacatttatctgccactttagtgacagggttaaggtagcgaacctggtacggacaagcgccaatgcaataactgcagccgatgcactgcgatttttctacccgcacgatcccctgctcatcacgccacgacgcccccgtcgggcaaacgtcgatgcacggagcatcttcgcagtgctgacatgactggcgaaaaaagtgatactgcgtttcgttgtcgttatcggtgactggaatgtgtgctatcgataaacggcttccctgagcggggacgtggttagttttacggcatgcgcgggcgcaaatattacagccattgcaccgtgactcgtcatgaatcatggcataccgaacttccttttcttgcctcgtgttcgctaacagagaagacgcagaaccagtaaaaaagattactgttcccatccccagaacaaatttgcgtcgagtgaaggacatctgattatcccctaatgcagtggctgcaactgtccaccctatccatgacatctccctgaaatttcaggggttctgaaactgctctacctcgaaccattcgcataagccataagccttgccataggtcataaatcgctcgctaaacaagtacaacaccgccgtcgatgactccacctgccgtatatcggcatattcaggtgcaacatccatcgcggcgatcgcggcttcaatctgcgcttcctggaagtaatatggcgcttgcatcagcatggcgactttgtaaggacgaggatacgtctggcactcaaaacgaacggcgtgtgcaatggcgcgacaaatgtcctgctccacaacttgcaaagacatcgccgcgtagttttcactcatggcctgcgttgagtaatagtaatcatccttgcttcccgtcaaacaagcgatatccgcgtagtctccgttctgcttaatgctttccagcaaaactgacagttcctcttctgcaaccaaatagggtggcgagagaaacacggcgcgcgccaccagctgcccagccgcagaatgctggcgaatgaactcagccaggatttcagcaggttctggttcggttaccgtatcaacggggtgacgcatcccctgcaaccattgccgcttcgcctcgtcaacttcgctgactttcgctaacggcaattcatcctgatggttcatcttacccattccttacgcaggcagtagattgtgtgctgccagatcggcggcaatatcttccagccccagacgctgcaatgtttcgcgggttggacaaccaagctgtgggtcccagcccatttctttgtagaacatcgtgagcgaagcatgcatatcgtcacgatccattttgtcagtaccttcagtaaagaccgggatctgcggatccttgtcgaatacccaggaacagataagatcgtgttcattacgcatatctttggtttgcatcagttttaccgtgtaggcacgatgcaacgtaaaaatacgctctgcagctaaatctaatttttcctgagtcatctcttcgccggtgatcgctttgaagaatttggcttcaagcgccagatcgccccggtaattacggcttttcagcggcgaaacggtcattggccagacccagttgcacagggtgacggcgttatgcaaacagacccgcaacagcgaccactttgcatatttaatttttgcgtcattgattggcgtgtagtttttggtttcatcgtaagcatcttcagaaccaaaaagttctttcgccacttcacgttgcagtttcaatggcaagccggaaccaataaagttgatatgggtatgcgtcatgcagtcacggttgaacatacagttaacaatggaaccgacctgcgctgacgcttcattggcatggtgaaccggatagccaaacggcgaccagagtttatttttcgcgtagccccagtactcttcacccaaattccagcgttctgcgatggcatatgaaccatcagccaggtgactcagctcacccacacgatgcgccagacggtagtaaaaatctttaatgaagttaacgtcacccgcttccagttgatcccagcgaatttctgcatactcttcagctggcagaacacgcttgaacacacctttgctgtaacaataagtaaagtcgcgatgcaactgcccgtagttacaccataggccgtagtcatcgaacaaattcagacccaccaggttaccaatcacacgaccatcgtctttatcttcaaaatctttcggcccgttcgggaagatggtggtatggacaaagtttgctacacaagtgttaccacctgtgctgggcacgccaaactctttcacccgaggaatattcatttgggtcatacaacggatcgggcaagagtggcagccgctcatttttactgtgtatttctctgccgccggtcctaagtcaaaaacggatttataggtacgaaagccgaccgtattctgattgcctggcggaatttcacccgtttcaatcggaccaccttcagccgcgccccaaaacagccctttacgtgctgtccagcgtgacttgggatctgaatactctgcccacgattgtggcgtacttggcacgacatggttgttattcgcaccaataagttcagtcatcatgtaatcattgagacgcttcatctcctgacgatcggcaatgttgacccctttcgtcccttcaaccgcaatcgctttcaggtttttcgaacccattattgcgccagttcccgcaccgccgctgtggttacggctattcaacatgccagagagaggaacaaggttttccccagcctgaccaatagccgccacacaggtttccggactggtcaatcgacaaatttcttccgtcgttgcgcgcgtcccttttccccataagaaatcggctttttccaggctaactttgtcatctttaatcttcagccataccggtgatttcgccttcccttcgataataatgacgtcgtatccagcgaatttcatttgcgctgcaaaaaagccacccatatgggcatcgacgactaaatttcctttggtaaaagtagaaagtgaggtgatatttacgcgagaactacagggggcaccagatccagttaatgggccggtagcaaagactaatttattcgcttcatcgaaaggtttcgtgcctggcggtacttcgtcatacataattttgtagccgaagcccatgccaccgacaaaacttttaaacttactggaatcttcgagggtaatatttcctgtcgtgagattgactcttaatatattacctgtccaaccgttagccatgattttttcctttgcaagattcacacagtaatatctttccactcgataatttttaacgcccctgttgggcaggcgtttgcgcattcaccgcataacacacatttcgaggattttttactttcggtatttacggtggccatcatccacgggcatgccgtagtacaggcgctacagccaatacagcgtttatgatcgacggtaatacagccttctttctgctgccaggtaatcgcaccaatcgggcagacgttcatgcattgcggctctttgcattgacggcaggtgtccgcggtatagttgagatcgccatacaggccgccgccagagccaaccccgttgtcgccaaagaaataattgcgatggattttgatacgggagaagaatgtccctactgagccatcgttgaagttggtacaagagatttcacagcggtggcaacccgtgcatcgcgctcgctgggtcaccagcacccctttgggggtatttatcaaccctactgtgccgctatcaatatcttcctgtttgcaacccaaaagtgacagtaacgcaggggcaattgttagaccagcaaggccttttcctgatatacgcaagaattctaatcgcgttaagccaatatctaatagtggacgatcaaccgggttcatttatttcgcatcctcttcgcaaacacagtgctgacaattcagcagcctgatattaagcattcaactaatacgctgctgactctgtccccaacaccagatattttccctaacccgatagtgtatgagaaaagattaacgccgataaactaatcctttatggttaggagaaaaaataatgtgattattctgagcccttaacattgatcgttatcaattaaaattacaaagcaagaaattataagtgaactgatatttattatcatttgaaataaatttaacttaagcgacaattatttgtgactttcattgcagaaaataaaaataacattatcgctataaattaaaatacataccgaaattcgtataatttcagcagttgttatttagaatgattaactggaccgcaactgaagcaagaatatcaggatgaagcttaccgcctcatcctgaatggtcattttaccagtgcgttaatgacggtttccatcgcctgcttttccagctcactgcgctgaatgcgtttattggctaatgctgtacgtaatacgcctgcgataacaatatgctttggttcctgccccagatcgcgcatttccagcacaactttaccgacaactctgcacatttctcggtacagttcatcctcttttgtccgatttcccattctttatacctatttatcatgccaactatcagcatatatcaatctaaccaattaaacaaaaatcaaacaaaatcagacaaataacgcgataaattattttaactgtagcaattgagcgatgatatatttatacaccggatgaactttcacttatcctcacactgacaacttcggcaccagacgttgcgcaaacagtgaagtttttgcgtaaccttttccctggaacgttaaatctttgataacaatttattgtctaacaagttgtatattttttgaaacgctgtttttgttttccttttggattaatttcagcgtataatgcgcgccaattgactcttgaatggtttcagcactttggactgtagaactcaacgactcaaaaacaggcactcacgttgggctgagacacaagcacacattcctctgcacgctttttcgatgtcacctatccttagagcgaggcaccaccactttcgtaataccggattcgctttccggcagtgcgcccagaaagcaagtttctcccatccttctcaacttaaagactaagactgtcatgaaaaagaccaaaattgtttgcaccatcggaccgaaaaccgaatctgaagagatgttagctaaaatgctggacgctggcatgaacgttatgcgtctgaacttctctcatggtgactatgcagaacacggtcagcgcattcagaatctgcgcaacgtgatgagcaaaactggtaaaaccgccgctatcctgcttgataccaaaggtccggaaatccgcaccatgaaactggaaggcggtaacgacgtttctctgaaagctggtcagacctttactttcaccactgataaatctgttatcggcaacagcgaaatggttgcggtaacgtatgaaggtttcactactgacctgtctgttggcaacaccgtactggttgacgatggtctgatcggtatggaagttaccgccattgaaggtaacaaagttatctgtaaagtgctgaacaacggtgacctgggcgaaaacaaaggtgtgaacctgcctggcgtttccattgctctgccagcactggctgaaaaagacaaacaggacctgatctttggttgcgaacaaggcgtagactttgttgctgcttcctttattcgtaagcgttctgacgttatcgaaatccgtgagcacctgaaagcgcacggcggcgaaaacatccacatcatctccaaaatcgaaaaccaggaaggcctcaacaacttcgacgaaatcctcgaagcctctgacggcatcatggttgcgcgtggcgacctgggtgtagaaatcccggtagaagaagttatcttcgcccagaagatgatgatcgaaaaatgtatccgtgcacgtaaagtcgttatcactgcgacccagatgctggattccatgatcaaaaacccacgcccgactcgcgcagaagccggtgacgttgcaaacgccatcctcgacggtactgacgcagtgatgctgtctggtgaatccgcaaaaggtaaatacccgctggaagcggtttctatcatggcgaccatctgcgaacgtaccgaccgcgtgatgaacagccgtctcgagttcaacaatgacaaccgtaaactgcgcattaccgaagcggtatgccgtggtgccgttgaaactgctgaaaaactggatgctccgctgatcgtggttgctactcagggcggtaaatctgctcgcgcagtacgtaaatacttcccggatgccaccatcctggcactgaccaccaacgaaaaaacggctcatcagttggtactgagcaaaggcgttgtgccgcagcttgttaaagagatcacttctactgatgatttctaccgtctgggtaaagaactggctctgcagagcggtctggcacacaaaggtgacgttgtagttatggtttctggtgcactggtaccgagcggcactactaacaccgcatctgttcacgtcctgtaatattgcttttgtgaattaatttgtatatcgaagcgccctgatgggcgctttttttatttaatcgataaccagaagcaataaaaaatcaaatcggatttcactatataatctcactttatctaagatgaatccgatggaagcatcctgttttctctcaatttttttatctaaaacccagcgttcgatgcttctttgagcgaacgatcaaaaataagtgccttcccatcaaaaaaatattctcaacataaaaaactttgtgtaatacttgtaacgctacatggagattaactcaatctagagggtattaataatgaaagctactaaactggtactgggcgcggtaatcctgggttctactctgctggcaggttgctccagcaacgctaaaatcgatcagctgtcttctgacgttcagactctgaacgctaaagttgaccagctgagcaacgacgtgaacgcaatgcgttccgacgttcaggctgctaaagatgacgcagctcgtgctaaccagcgtctggacaacatggctactaaataccgcaagtaatagtacctgtgaagtgaaaaatggcgcacattgtgcgccattttttttgtctgccgtttaccgctactgcgtcacgcgtaacatattcccttgctctggttcaccattctgcgctgactctactgaaggcgcattgctggctgcgggagttgctccactgctcaccgaaaccggataccctgcccgacgatacaacgctttatcgactaacttctgatctacagccttattgtctttaaattgcgtaaagcctgctggcagtgtgtatggcattgtctgaacgttctgctgttcttctgccgatagtggtcgatgtacttcaacataacgcatcccgttaggctccacggaatatttcaccggttcgttgatcactttcaccggcgttcccgtccgcacgctggagaacaaggctttaatatccggtgcattcatgcgaatacaccctgaactgacgcgcaaaccgacgctgtccggcgcactggtaccatgaatgaggtattcgccattaccatgcgcgaggcgcagtgcgtaacgtcctagcgggttatttggtccggcaggaacgactggcggtaatttaatgccacgctccagcgaacgctgacgaatgcctgccgtaggcgtccaggttgggttagggattttctgcccaacacgcgtttccatcaccggcgtttccagcccctgcaatccaatacctattggataaacctgcacaatattttctcccggcggataataataaaggcgcagctctgcaaggttaacgataatcccctgacgcggtgcatcaggtaataacagttgtgaaggaatagttatcgtcgtaccaggttttggcaccggggcgatagtgttattggcttcaaggatcaacattgccgcagtatcaaaacgtcgggcaatagcctgaaggtttttatccccttcttgcaccgtatacgtttgattttgcccaaccagtcggcttccggttggtggtagcggataatcaaccgcccaggcagcctggatggcgctaaaagcgccgataagcgtgagtgtaagcaaagacgcgcgtttcattgtaaacctcctgtatttgccggagactcacgctgaaacgtcggatggcgcttatgttcacctgaaaccaaaacactcctgtgcaggtcagtgtaaacattgaccatccggcaatgtgagccaaccggatgaaagctgtccttttagtttagctaagtgcagcggctttggcgcgaattgcgcgaatcatcgcttccagaccttgtgaacgagatggggtgagatgttgggtgagcgccattttttcaaaccacggacgcacatcgaaattgacaatatcctgcggcgtcatctgatcgtagagaataaagacgaccgcaataagccctttcacaatcgccgcatcgctgtcgccctgtaattcaataattccctgggcattctggcgcatgacaatccacacctgactctgacagccctgaatgctattttgtggacttctgtcttcgtcgcgtaattctggcagacgctggcccagctcaataatgtagagatatttctcttcccagttggcgcagcgtaaaaaattacgcagcaacttttctttatccggcaataaagccatagtgcctccctgttatcccagcaaacggtgaatacgttgcaggccggtcaccagacgatccacttcttcatgggtgttatacatggccagcgacgcccgacacatcgcagggacgttgtaataggccatcaatggcattgcgcagtgatgtccggtacgcacagcaatgccgtaattatcgagaaaactgccaacatcataggcgtggtgtttaccgagattaaaagcaataacgccaagcctgttttgtgggccatagagagtgagatccggtacagattccagctgtgatagcgcataatgcatcagattctgttcatactcggctatgttattaagccccagcgccgaaacatactccagcgccgcgccaagaccaatgatgcccccggtattgggtgtaccggcttcaaaccgccatggtgctttggtccaggtagtgccttcactcaggctgacggtggcgatcatagaaccgcccccttcccacggcggcatctcctgcaacaaggcttctttcacataaagaatgccaattccggtggggccatacagtttatgcccggagaacacgtaaaagtcgcaatccagcgcctgaacatccaccggatgatgcatcaccgcctgagcgccatccaccagcacttttgcgccatgctggtgcgcaagcgtgatcatttccgccagtggattttctgtgccaagcacgttggagacatgagtaattgccagcaggcgagttttctcatcaaacagcgtaggcagcgtctccagttgcaacgtaccatcgggattgagcgggatcacacgcagctctgcgccaacgcgtgcgcaaagcatctgccagggaacaatgttagcgtggtgctccatctgactgatgatgatgttatcgcccgcccgcacgttgctgttgccccagctattggcgaccagattgatcccttccgtcgtgccgcggacgaacaccagctcttccgccgaacgggcattaataaacagcgatgcccgcttgcgcacgttctccattttctcggtcgcctgggcgcttaaggtatgaataccacgatgcaccgccgcgtagccatgacgataaaactcggcctcggcgtcaatcacctggctcggtttctgcgcactggcggcgctgtcgagataagccagcggcaaaccgtttacctcacgcgaaagcaccggaaagtcggcccgcactttgtcgacggaaaaaatcatcttgcacctcctggcagccgttgaccgattcgggccagcacctgctgtttaagcccctcatcacgcagtgcttccgtcagttcggcagcgaaggcgtaaatgatcatctgctgggcatcctgctgattgatcccgcgcgagcgcagatagaatatctgttcatcatcaatacgccccaccgtcgcgccgtggctgcatttcacatcatctgcatagatttccagctgcggtttcgtatccacttccgccagtttgcccatcagcagattgttgttggtcatctgaccatccgttttgatggcgtgctgcgcgacgttgatcaaaccgttaaataccgcgcggcctttgtcgctgacgatagttttgtgcaactgtcggctgttacaaaaacctttattgtgttccagccaggtacgggtatcacacacctcgtttttcaccggcatcgccaggctattgatccgcagcgtgctgttttcgccattgagttgcgtactggtgttgtgtcgtaacactgcgccacccagcaggaaactgtggctaaatgcggtggcatcctcagccagcaacaaatcgttatgagcaaagtggtgactgagcgggttttcaaacgccagcttgatatgctgcaagtgggcattcgctgcgacgttgatagtgaaccgtgccccggtaaaatgacgagcatcattcaggctgacaaaatgttcgatcaccgttgcttcggcaccttccgccagatccagatgatgtcggtaatgggcagtgttcacctcttcacctgccacgccctgggtgatatgcattaacagcaatggctttgccggccgttgaccgcgcttcacggcgatatgcgtcacgctttgtgccaggctttccgtcaaatgcagaaacacttccgcctgaatagcgtcgggtaaaccctgacggtcgtcgttaatgctcacttcatatccgctgccttcagttgcatcgctcagtgcgggcacgtaacgcccatcgacaaacaccagccgcacggagtctaacgttaacgctaaggcatcacgctgctgtggggatatctctcccgcaatgctgacaaactggctattgatcagcccttccagcggcgtatatttccagttttcatgtttacgtgtcggcagtccggtacgcagcaattgttgtaaatgctgctgtgcttgcggggagcgttttgtcccttcagcttcaaacaagtgatgccactgttgcagcgcgttactgctgttcggtaagccagccataaccctgctcctccagttgtttgaccaacgtgaaatcgccggatttcacaattcgtccctgatatagcacatgaacgtaatcaggcttgatgtagtcgagaatgcgttggtagtgcgtaacaatgatgaatgagcgcttgccatcacgcagcgagttcacgccatcggcgaccacttttaatgcgtcaatatccagcccggagtccgactcatcaagaatgcataactccggttccagcaccgccatttgcaaaatatcgttgcgctttttctcgccgccggaaaaaccaacgtttaccgaacgggttaataaatcttccggcatcttcaggagagcgattttctcttccatcaaatcctgaaaatcaaagcggtcgagcgtttcctggccgcgatagctgcgcaccgcattaagtgccgtttgcaggaaaaactggttactgacacctggaatctccaccggatactggaaggccataaagatgccttcgcccgcgcgatcttccggcgacagcgcaagcaaatctttgcctttgaactcaaccgtgccgcccgtcacttcataatcttctcgcccggcaagcgttgccgataaggtacttttgcccgaaccgtttggccccataatggcgtgaacttcgccgggatgaacgtcgaggcttaatccgcgcaggatagctttatcttccacgctgacgtgtaaatctttaatacttaacatgtttattccttatccgacgctgtgttcaagactgatggcgaggagtttttgtgcttcaacggcaaattccaacggcagctccgagaacacgtctttgcagaaaccgttaacaatcatcgagatggcgtcttcttcgctgatcccgcgttgcaggcagtaaaacagttgatcttcaccaatacgtgatgtcgttgcctcgtgttccagttgcgcactattgttacgacactcaacatacgggaaggtatgcgccccacaattagcgccaatcagcattgagtcgcactgagtgaaattgcgcgcattggttgccgtcggcatgattttcactaagccgcgataactgttctgactatgtccggcagagatccctttcgagataatggtcgatttggtgtttttaccgatgtggatcatcttggtgccggtatccgcttgctgatgaccgctggtcagcgccactgagtaaaactcaccaatggagttatcgccgcgcaaaatgcagctgggatatttccacgtaatcgctgacccggtttctgattgcgtccatgacattttgctgttttcgccttcgcacaaagcacgcttggtgacgaagttgagaataccgccggtgttgttatcgccaggaaaccagttttgtaccgtggaatatttcacctcggcgtttttatggatgatgacttccaccactgccgcgtgtaactgatagctgtcacgcaccggagcggaacagccttcaatgtagctgacgtagctgtcttcgtcggccaccagaatggtgcgctcaaactgcccggttttttctgcgttaatgcgaaaataggtggaaagttccatcgggcagcgcacgcctttaggcacataaataaacgtaccatcagaggctaccgccgcattaagcgcggcaaagaagttgtcattccccggcaccacggtgccgagatatttacgcaccagttccgggtgatcgtggatcgcctcaccaaaggaacagaaaataattccctgctccgccagtttttcgcgataagtagtggcaaccgaaactgagtcgaaaatggcatccaccgccacctctttgccttcccgcacgggaacgcccaactgctcaaacgccgcctccacctctttacttaaaaaggcgttcgcgccagtttgctgcaccgcgccaggttcagacgcgcaagtgtcgtcacaattaccgcacgatggtgctgagtagtagctgtaatcctgataattcagcttgtcgtagtgcgctttcaaccagtgcggttcttccatctccagccatgcgcgataggcgtttagacgaaactccagcatccactccggctcattacgcttcgccgaaattgcgcgcaccacctcttcgtttatcccctttgccagctcatcggtggctaactgggtgaagaatccttctttataattcagcgggccgccggtccaggttttgacatcgtcagttgcttcagtattacgagacatagtaccgcctataccccaaagctttcgccacagccacattcattctgggctttagggttgtgaaatttgaatatctgattaagtccttcacgaacgaaatcgacttccgtgccatcaataaacggcatcgcttgcagcgggacaaacagcttcgcgccgtcgtgttcaaacagcagatcgtctttgtccggctcgctaacactgtcgagcacatagccaaagcccgcgcagcccgtttgcttcacgcctaagcgcacgccgaccatacccggctgctttgccaccagctcacggatgtgtatcgccgctgcgggtgtcagcgttaagccttgccaggcgaaatcttgtgggttaaaggttcctgaatgcatgtccatcgatttacctcacttcatcgctttcagcgtataacagcatgttagtgataatgattatcagttcaacccagcaaacgcaggggctttaccgtaaaacatgctttttgcctgcttttaataagcatagaccctgatgtgtgggttaacaggcacgctaagaattaggtatctcattgttagataatggttattatctaaggagcattaaggctgtgatgaaaaagaaaaagttgtattgaaaatgactatttaagagataggtaaaaaagtgcagcgttcagaaataagaaaacccttaagtctgtgcgacacaggcttaagggtttctaccccatccggcgcttatctccggcactctcagtggcttagctcttgaaggggcgataagaataatctcataaagctaacccgccgttttaacacaaactgcgattagtattatttttgaacaatatcaggcggtagataagcagtattaagaaggtcatcgaacctggacggaggttaatccaggtcgatttggcgaacttgcggcattaagtcaggatcaatgcacgcccagacgccaggcaaagtagatttcttcttttaattcagcagaagagagagtaagcaggtcagcaaattcaagttctagttgtttcagacgtttgagatattgggcaggtgaaagattgctctggtcacggcgtaaaaattcaatggccagctgggtgggatcaagttgagtagacatagcatcctcgcttttagacaagacctgcacagtataccaccgtttactgtgcagataatgaccaaaagcaatatgcgtcacacttttctggtgacaacgtcacaaaatggcggtcgtcaatcgtgacgaacagcacaaacgccctttctcatcgaagatttcaatctgccagacctggtgacgcgaaccgagatgcaacggtttgcatacgccgcgcacccgcccttctcgtgccgagcggacgtggttagcattgatttccagaccaaccactttttgctcaccttcggtacataaataaccggcaacggaaccgatactttcggccagtaccacggatgctcctccatgcagcaacccgaaaggctgctttgtccgcgagtctactggcattgtcgcttcaagggtgtcatcaccaatatgttcaaagcgaatatccaggaaccccaccatgtttccttcacccatagcattcagtgcttccagggtgattttccgtttccatatcatttaataatctccagtaaagcctgcacaggatggcgtacccccgtgccttcaacccgttttacctggctacggcaggaatatccggtcgccagacagcggttacgcggcagtcgctgcatagcctgatgccaggataactcatagatcccgagcgaattttcatggtttttcgcttcatgtccgtaagtccctgccatgccgcagcaacccacgctgacattttccagtttcgcgccaaaacgggcaaatatcgcggcccattgtgctggcgcacccggcaaggcggtaacttcggtacagtgaccaaagaaataccatgattcaccgctgactgtagccactggctgtgactcaagtgcgcttgccagccattcattcgccagtaagacgttaaactcgccacgctcctcgcccagcgccagtttatattcatcgcgataacaaagtaccagcgccggatcgacgcccaccattggcatacccagcttcgccatacggttgaggaaatccgccgtctttttcgccgtcttcgcaaaacgattaagaaaacctttaatatgctgggctttgccatttggcgaaaatggcagtaacacaggctggaaacctaatttttcgaccagacggacaaaatccgccaccacttgcgcatcgtaatagctggtaaaggggtcctgcaccaccaacactgtgcgcgctttctgctctgcattgagagattcaagctgttccagcgtcatgtttgccgagcgatgccccaccatttgttgttgtagcgaggggaccgacagcagcggcaaatcaaccatgccgatatgtttttccgagagtttgcgcaccagcggctggttaatgaagaagttaaaggttttcggcgcgcgtgccatcagcggcgcgtagctctcgaccgtagcgacgaggtggtcgcgcagcgggcgtaaataacgggtgtgatagagctgcagaaaacgagagcgaaactccggcacatcaattttgatggggcactgggtcgaacacgctttacaggccagacagcccgacatcgcctctttgacttcgtgtgagaagtcatattcgcctttattcgcatgccagctattgcgcgtgcgggcaattaacgtccgcaaactgacgccggattcaggcagttcttgttccagtttgagtggatcaacgccgcgatccgccaacaaacgcagccattcacgcaccagcgttgcgcgccctttcggtgaatgaatccggttctgggtgatcttcatcgacggacacatcggactacgggcatcaaagttgaagcataaaccgttgccgttacactccatcgcaccgcgccactgctggcgtaccgcaatggggatctgccgatcgaatgtaccgcgcttcaccgcgtccactttcatcatcggcgcatcgagaccttctggcgggcaaatcttccctgggttgagtcggttatgcgggtcaaatgccgctttcactttgcgcagttctgcaaaaagttcctcaccgaaaaacgccgggctgtattcagcgcgaaaacctttgccgtgctcgccccacaacaaaccaccgtatttcgcagtcagcgccaccacgtcatcagagatttgcttcatcaaaatctcttgttgaggatcgcacatatccagcgctggacggacgtgcaagacacctgcgtcgacgtgaccgaacataccgtagcttaagccgtggctgtcgagcagcgcgcgaaattcagcaatataatccgccaggtgttccggcggtacgcaggtatcctcagcaaacggaattggcttagcggcacctttggcattgccaagcagaccaacggcttttttgcgcattgcatagatacgttcaacccccgccagctcacggcacacctgccagccgatgacacctgcttgatgactggcgatcagctcatccaaccgcgcacagagtgcatttacccgctcatcaatcagcgcctcatcatcaccagcaaattccacaatgttcagcccgagcatctcttggtcaggcacatcggtaatcaactcgctgacggaatgccagacaatatcttcccgcgccagattcagcacttttgagtccaccgtctctaccgaaagcgcccgcgcctcaaccataaacggcgcgttacgcagcgcagagtcaaaagagtcatatttgacgttcaccagacggcgcactttaggcaagcgtgtaatatccagccgcgcttcggtaataaaggccagcgtcccttctgaacccgtcagaatgcgcgtcaggtcgaactcggtcatctcatcgttaaagacatgacgcagatcgtaaccggtaagaaagcggttaagtttggggaagttgtcgataattaactggcgttgctgacggcaacgttgataaaccgtgttataaattcgcccgattgtggtattggatttacccagcgtttccgccaattcgacgggtaaaggttgcgtatcgagaatatcgccccccaacaacaccgcgcgtacgccaagtacgtgatctgacgttttgccatagaccagcgatccctgaccggatgcatcggtattgatcatcccaccgagcgttgcccggttgctggtcgaaagttccggcgcaaaaaagtagccgaacggtttcaggtactgattgagttgatcttttatcaccccggcctcaacgcgcacccagccctcttcagggttaatttcgatgatgcggttcatatggcgggacatatcaacaataatcccctggttgagcgcctgaccgttagtgccggtgccgccgccgcggggggtaaagatcagcgatgaatagcgttcctgcgcggcaagacgggcgatcagcgccacatctgcggttgaacgcggaaataccaccgcatcggggagaagttggtaaatactgttgtcggtcgacattgtcagacgatcggcataacttgtcgccgtatcgccggtaaaaccttgttgctccagctcttgcaaaaaattaagcaccagttgaacgacgccgggtgcctgggaaatctgtggaatcattatattgaccctttcctgcggtctgtgatgtaggtcgatacactattctttcaggctgctgcaatagcgcactgaaaggtgatgtttgtttactctatggatttcgtgttgcaggaaggcggcaagcgagtgaactccaggagcttacaatagtaagtgactggggtgaacgaacgtagccgcagcacatgcaacttgaaatacgacgagtaaatcgtttgcgtgttgcctgagttgttgtaccacatttttttctaacacgcccatcagaattaagggcagaatcggcctgttaaaaaccgctgaaattgctcatcattatgcaggtgagtttcgcgtgttcacgtcgcgtcgacgatttgacgcacaaaaaaggtgaaaagtagttatggtaaatgttcgtcagcccagggatgtcgcacaaattctgctttcggtgctgtttttagccatcatgattgtggcatgtctgtggattgttcaaccctttattctcggctttgcatgggccggtacggtggttatcgccacctggccggtattgttacgtttgcaaaagatcatgtttggccgccgctctctcgccgttctggtgatgacgctgttattagtgatggtgtttatcatccctattgctttgctggttaacagtatcgtcgacggcagcggcccgctaattaaagccatttccagcggtgacatgacgttacccgatctggcgtggcttaataccattccggtgattggcgcgaagctgtatgcaggctggcacaacttgctggatatgggggggacggcgatcatggcgaaagtccgcccttatattggcaccaccaccacctggttcgttgggcaggcggcgcatatcgggcgctttatggtgcattgtgcgctgatgcttctcttcagtgccctgctgtactggcgcggtgaacaggtggcacaaggcattcgccattttgcaacccgtctggcaggcgttcgcggagatgccgccgtgctgctggcggcacaggctatccgcgcggtggcgctgggtgtggtggtgacggcgttagtacaggcagtgcttggcggtatcggcctcgccgtatccggcgtaccttatgcaacgttgctaacggtgttaatgatcctctcctgccttgtccagcttggcccgttgccggtactgattccggcgattatctggctctactggactggcgataccacctggggaacggtattgttagtgtggagcggtgtggttggcacgctggataacgtcatccgcccaatgttaattcgcatgggtgccgatttaccgctgatcctgattctctctggcgttattggtggtttgattgctttcgggatgatcggtctgtttattggtccggttctgttagccgtttcctggcgtctgtttgccgcgtgggtggaagaagtcccgccgccgacggaccaaccggaagaaattctcgaagaacttggcgaaatcgagaaaccgaataagtaatttctcatcaggcggctctgccgcctgattgttaaccaccgctaattgatatttgcttgctcttccccatattttcctgcttaccgccattcagctggtagtacctgtcgcaaattctttacagtttttaaactaatgagacgaatctgatcgacgcaaaaagtccgtatgcctactattagctcacggttataaatcaacatattgatttataagcatggaaatcccctgagtgaaacaacgaattgctgtgtgtagtctttgcccatctcccacgatgggcttttttttaacatttttccgcttcgctacctcgcccctcactctttccaataatgttgcacaagatactgtgactctcttcaagccgtcagcaggctgataatgttatttatattttattgtttatttcatgcagccattacacgatgaacgcttatgaactccaggcactccgccatatttttgccatgactattgatgaatgcgcgacctggattgcccagaccggtgacagtgaaagctggcgtcagtgggaaaatggcaagtgtgccattcctgatcgtgtagtcgagcaactgttggctatgcgtcagcaaagaaaaaaacatcttcatgccatcatagagaaaataaataaccgcatcggcaacaacaccatgcgttttttccccgacttaaccgcatttcaacgagtctaccctgatggcaattttattgactggaagatctatcaatcggtagctgctgaattatatgcacacgatctggagcggctttgttaatttttccacagaaaggaattgtcgttgttacaacaataatgaacggatgctgacacaacatcgcttcactttttaaagcacctttgctaagtagaacctatgaaaaatccctatttccctaccgcacttgggttgtattttaattacctggtgcatggtatgggcgtccttttgatgagcctgaatatggcctcgctggagacactttggcagactaatgccgcgggtgtctcgatagttatctcatcgctgggcattggtcgattaagtgtcttgctttttgcaggattattatccgatcgctttggtcgccgcccttttatcatgctcgggatgtgctgctatatggccttcttttttggcatcctgcagaccaataacatcattatcgcttatgtttttggctttctggcgggaatggcaaacagttttctcgatgcaggcacttatcccagtttgatggaagcttttccacgctcacctgggacagccaatattttaattaaagcatttgtttccagcggacaatttttattaccgctaatcattagcctgttagtgtgggctgaactgtggttcggttggtcctttatgattgctgcaggcattatgtttattaacgctctgtttttataccgttgtacgttcccaccccatccgggtcgtcgcttacctgtcataaagaaaaccaccagctctacggaacatcgctgttcaattatcgatttagccagttataccttatatggctatatctcaatggcaacgttttatctggttagccagtggctggcacagtacggacaatttgttgcaggcatgtcatacactatgtcgatcaaactactcagtatctacaccgtgggttcgctgctttgtgtatttattaccgctccactcattcgtaataccgttcgcccaacaacattactgatgctgtacacctttatctcatttattgctctgtttaccgtctgcctgcatcccacattttatgtggtgataatatttgcttttgtcattggttttacctctgctggaggtgttgtgcaaattggcctgacgttaatggctgaacgtttcccttacgctaaaggtaaagctacagggatctattacagtgcgggcagtattgcgacctttactattccgttgattacggctcatctgtcccaaagaagtattgccgatattatgtggttcgataccgccatcgctgccatcggttttttactggcactgtttatcggcttacgcagccgcaaaaaaacgcggcatcactcgctaaaggaaaatgtcgctccgggtgggtaatgcaatattcttttcaggtcatgcaagatcttacggataaataactctttctgcgctaactaaggaaaatcgcgatcaaaaacaaactatgacatgcaatattcctggaaacataaactttatgccatgtacccagggaaaatcatcttcagtatagtaattatgtaaaccgtcggagaacaatacgtacggtaacgaaattatctttcagcaaggagctgtgaaaatgtctcaaaataaggctttcagcacgccatttatcctggctgttctttgtatttacttcagctacttcctgcacggcattagtgttattacgcttgcccaaaatatgtcatctctggcggaaaagttttccactgacaacgcgggcattgcctacttaatttccggtatcggtttggggcgattgatcagtattttattcttcggtgtgatctccgataagtttggtcgtcgggcggtgatattaatggcagtaataatgtatctgctattcttctttggtattcccgcttgcccgaatttaactctcgcctacggtctggcagtgtgcgtaggtatcgctaactcagcgctggatacgggtggctaccccgcgctcatggaatgctttccgaaagcctctggttcggcggtcatactggttaaagcgatggtgtcatttgggcaaatgttctacccaatgctggtgagctatatgttgctcaataatatctggtacggctatgggctgattattccgggtattctatttgtactgatcacgctgatgctgttgaaaagcaaattccccagccagttggtggacgccagcgtaactaatgaattaccgcaaatgaacagcaaaccgttagtctggctggaaggtgtttcatcggtactgttcggtgtagccgcattctcgaccttttatgtgattgtggtgtggatgcccaaatatgcgatggcttttgctggtatgtcagaagctgaggcattaaaaaccatctcttattacagtatgggctcgttggtctgtgtctttatttttgccgcactactgaaaaaaatggtccggcccatctgggctaatgtatttaactctgcactggcaacaataacagcagccattatctacctgtacccttctccactggtgtgcaatgccggagcctttgttatcggtttctcagcagctggcggcattttacagctcggcgtttcggtcatgtcagagttttttcccaaaagcaaagccaaagtcaccagtatttatatgatgatgggtggactggctaactttgttattccactgattaccggttatctgtcgaacatcggcctgcaatatatcattgttctcgattttactttcgcgctgctggccctgattaccgcaattattgtttttatccgctattaccgcgttttcattattcctgaaaatgatgtgcggtttggcgagcgtaaattttgcacccggttaaacacaattaagcatagaggttaaaggagttaattatggatgttaccgcaaaatacgaattgattgggttgatggcctatcctatccgccacagtttatcgcccgaaatgcagaataaagccttagaaaaagcgggattgccatttacctatatggccttcgaagtggataacgatagctttcctggagcaattgaaggattaaaagccctcaaaatgcgcggaactggtgtatcgatgccgaacaaacaactggcgtgtgaatatgttgatgaattaacaccagctgccaaactggtgggggccatcaacaccatcgttaatgatgatggctatctgcgtggctataacaccgacggcacgggccatattcgcgccattaaagagagcggttttgatatcaaaggcaaaacgatggtgctgttaggggccggtggtgcctcaacggcaattggcgcgcagggggcaattgaaggtttaaaagaaattaaactctttaaccgtcgggatgagttcttcgataaagccctcgccttcgcgcagcgggttaatgaaaacaccgattgtgtcgtcacggtcaccgatctcgccgatcagcaagcctttgctgaagccctggcttccgccgacattttaaccaatggcacaaaagtgggtatgaaaccccttgagaatgaatcattggttaatgatatcagtctgttacatccgggacttctggtcactgaatgcgtgtataacccgcatatgacgaagttattgcagcaggcgcaacaagctggttgcaaaacgattgatggatacggcatgttgttgtggcaaggggctgaacagttcacattatggactggcaaagatttccctctggaatatgttaaacaggtcatggggttcggtgcctgacaggctgaccgcgtgcagaaagggtaaaaaatgaaaaccgtaactgtaaaagatctcgtcattggtacgggcgcacctaaaatcatcgtctcgctgatggcgaaagatatcgccagcgtgaaatccgaagctctcgcctatcgtgaagcggactttgatattctggaatggcgtgtggaccactatgccgacctctccaatgtggagtctgtcatggcggcagcaaaaattctccgtgagaccatgccagaaaaaccgctgctgtttaccttccgcagtgccaaagaaggcggcgagcaggcgatttccaccgaggcttatattgcactcaatcgtgcagccatcgacagcggcctggttgatatgatcgatctggagttatttaccggtgatgatcaggttaaagaaaccgtcgcctacgcccacgcgcatgatgtgaaagtagtcatgtccaaccatgacttccataaaacgccggaagccgaagaaatcattgcccgtctgcgcaaaatgcaatccttcgacgccgatattcctaagattgcgctgatgccgcaaagtaccagcgatgtgctgacgttgcttgccgcgaccctggagatgcaggagcagtatgccgatcgtccaattatcacgatgtcgatggcaaaaactggcgtaatttctcgtctggctggtgaagtatttggctcggcggcaacttttggtgcggtaaaaaaagcgtctgcgccagggcaaatctcggtaaatgatttgcgcacggtattaactattttacaccaggcataagcaataatatttcggcgggaacaccctccccgccgaactaaaaaatatattcaatcgtatttaataaaaatatttcgtgagtctctgtgcgctaattctccatttggcgtagggaaaatcacatctgaatcaggaattaacaatgaaacctgtaaaaccacctcgtattaatggacgagtgccggtcctgtcggcacaggaagcggtgaattatattcccgacgaagcaacactttgtgtgttaggcgctggcggcggtattctggaagccaccacgttaattactgctcttgctgataaatataaacagactcaaacaccacgtaatttatcgattattagtccaacagggcttggcgatcgcgccgaccgtggtattagtcctctggcgcaagaaggtctggtgaaatgggcattatgtggtcactggggacaatcgccgcgtatttctgaactcgcagaacaaaataaaattattgcttataactacccacaaggtgtacttacacaaaccttacgcgccgccgcagcccaccagcctggtattattagtgatattggcatcgggacatttgtcgatccacgccagcaaggcggcaaactgaatgaagtcactaaagaagacctgattaaactggtcgagtttgataacaaagaatatctctattacaaagcgattgcgccagatattgccttcattcgcgctaccacctgcgacagtgaaggctacgccacttttgaagatgaggtgatgtatctcgacgcattggttattgcccaggcggtgcacaataacggcggtattgtgatgatgcaggtgcagaaaatggttaagaaagccacgctgcatcctaaatctgtccgtattccgggttatctggtggatattgtggtggtcgatccggatcaaacccaactgtatggcggtgcaccggttaaccgctttatttctggtgacttcacccttgatgacagtaccaaacttagcctgcccctaaaccaacgtaaattagttgcgcggcgcgcattattcgaaatgcgtaaaggcgcggtggggaatgtcggcgtcggtattgctgacggcattggcctggtcgcccgagaagaaggttgtgctgatgactttattctgacggtagaaacaggtccgattggcggaattacttcacaggggatcgcctttggcgcgaacgtgaatacccgtgccattctggatatgacgtcccagtttgatttttatcacggtggcggtctggatgtttgttatttgagttttgctgaagtcgaccagcacggtaacgtcggcgtgcataaattcaatggtaaaatcatgggcaccggtggatttattgatatcagtgccacttcgaagaaaatcattttctgcggcacattaactgcgggcagtttaaaaacagaaattaccgacggcaaattaaatatcgtccaggaaggacgggtgaagaaatttattcgggaactaccggaaattactttcagcggaaaaatcgctctcgagcgagggctggatgttcgttatatcactgagcgcgcagtattcacgctgaaagaagacggcctgcatttaatcgaaatcgcccctggcgtcgatttacaaaaagatattctcgacaaaatggatttcaccccagtgatttcgccagaactcaaactgatggacgaaagattatttatcgatgcggcgatgggttttgtcctgcctgaagcggctcattaacaggagtataatgatggatttttctttaactgaagaacaagaactgctgctggccagtattcgcgaactgattacgactaactttccggaagagtatttccgcacctgcgatcaaaacgggacatatccgcgtgagtttatgcgggcgctggcggataacggtatttccatgcttggcgtgccggaagaatttggtggtatccctgcggattacgtcacccaaatgctggcgctgatggaagtgtcaaaatgcggtgctccggcatttttaattaccaacggtcaatgtattcacagtatgcgccgtttcggttctgcagagcagctacgtaaaacggcagagagcaccctggaaacgggtgatcccgcctatgccctggcgttgacggaaccaggtgctggctcagataacaacagtgccactaccacttacacgcgtaaaaacggcaaggtctacatcaacggacaaaaaacctttattaccggtgcgaaagagtacccgtatatgctggtgctggcgcgcgatccgcaaccgaaagatcccaaaaaagccttcaccctgtggtgggtcgactccagtaagcccggcattaagattaacccgctgcataaaatcggctggcatatgctcagcacctgcgaagtctatctcgacaacgtggaggttgaagagagcgacatggtgggcgaagaaggaatgggtttcctcaatgtgatgtacaactttgagatggagcgcctgatcaacgccgcgcgcagcaccggctttgccgaatgcgcctttgaagatgccgcccgctatgccaaccaacgtatcgcttttggtaagcccattggtcataaccagatgatccaggaaaaactggcgctgatggcgattaagatcgacaacatgcgcaacatggtgctgaaagtggcatggcaagccgatcagcatcagtcactgcgcaccagcgcggcgctggcaaaactgtactgtgcacgtaccgcaatggaagtcattgatgatgcgattcaaatcatgggcggtctgggctataccgatgaggcgcgcgtctcccgcttctggcgtgatgtccgttgtgaacgtatcggcggcggtacagacgaaattatgatttacgtagcaggtcggcagatcctgaaagactatcagaacaaataatctgcaggcggcgcagcttcttaacaaactgcgccgccagatttatccaacaagacttaccggttgaggaaattcagataggatttcttgttccgcaaaacagtttttaaattgtctacggtaatcgctgggcgaacaaccgacatggcgcaaaaacagtttggcaaagtgatcgacattttcataacccacacgccaggagatctctgcctgtgataattcagtattagtgagtgaccattttgcttccgtcatacgccgttgaataacatagttaataggggaaatacgatactctttggtaaattcatggcaaatataactgacgctggcacgaaattttttcgataactgttctaaagtgattttttcgcgataattattattcagatagaaaagaatatcttttatcagaacatcttttttaatatacccctgctccgaacgataagcatttttaaaattttcgtagtaaagaatggctaacgtataggcaaatgcatcccataacgaagatgtttggctatttttactttgcggcaaaatcacacttagctcattaaataaggtttttatgacttcttttccctgccccgcggcaattaccggacaagaatgcggttgcagtagctgattttcctcagccccctgaaactgaaagccgtacagcgcacaggtacacgtcgttgccggatcgttaacgtcagaggccaccgcatgcagcctgccgcgttctatcaccacaatgtcatccgcatgtgcgacatataacgaagaatcgatggtaaaccttgcaacccctttcttgacgtaaatcaactcggtttcattgtcatgaacgtgatgtccggactcccattttggatcatcgctaaatgcaaaacgtgaaagccgtggcgttttaccggcgacaaacagcgtttcactggcgttatcaaaacagcgttgatacatgacaacctccctattccatgagcaagcaaaaacaatatatgccggataaaatacggcgtgtattgcggttatacaaccgcgtttagcgagagctaaacaagattatttacactgaatgcaagattgtacggtcatggaataactatattgccgcaaattgcacttttgttttagcgatcgcattttttttgcaagattgttggcaaggaaaacagcttgctccgtcgaaaaccccgcaccgctatcgcacactattttcaggccatttttaccttccatcggagatggttccgtatgcgactcacaggagaaatcatgaaaataataacctgctttaagctggtgcctgaagaacaggacattgttgtcactccagaatacaccctgaatttcgacaatgccgacgccaaaatcagccagttcgatctcaatgccattgaagctgcaagccagctcgcaacagatgacgatgagatagccgcgctgaccgttggcggctcattgttgcagaactcgaaagtgcgcaaagacgtgctatcccgcgggccgcacagcctgtatttggtgcaggatgcgcaacttgaacatgcactgcctctcgataccgcaaaagcgctggcggcagcaattgaaaagatcggcttcgatttactgatctttggtgaaggttccggcgacctttatgcccagcaggttggcttgctggtcggagaaattctgcaacttccggtgattaatgcagtgagtgctattcagcgtcagggcaatacactggtgattgaacgcacgcttgaagatgatgttgaagttattgaactctctgttccagccgtgctctgcgtcacctccgatattaacgtgccacgcattccttcgatgaaagccattctcggcgcgggtaaaaaaccggtaaatcagtggcaggcaagtgatattgactggagccagagcgcgccacttgctgaactggtcggcattcgcgtaccgccgcaaacagaacgtaagcacatcattatcgataacgattcgccggaggccattgccgagctggcggaacatctgaagaaagccctgaactgaagcctacggagaagaaacgatgagtcaattaaacagcgtctgggtctttagcgataatcctgaacgttatgctgaactgtttggcggcgctcagcaatggggccaacaggtgtatgccattgtacaaaataccgaccaggcgcaggcagttatgccttatggtccaaaatgtctttatgttcttgcgcaaaacgacgcgctgcaacgcactgaaaattacgccgaaagcattgctgccctgctgaaagataaacaccccgctatgttgctgttggccgcgacgaaacgtggtaaagcgctggcagcacggttaagtgtgcaactgaatgcggcgctggtgaacgatgccacggcggtggatattgtcgatggtcacatttgcgccgaacaccggatgtatggcgggttagcgttcgctcaggaaaagatcaacagcccgctggcgatcattacccttgcacccggtgttcaggaaccgtgcaccagtgatacctctcatcagtgcccgacagaaacggtaccttatgttgctccgcgtcatgaaattctctgtcgcgaacgccgtgcgaaagccgcaagcagcgtggacctgagcaaagcaaaacgtgtggttggcgtcggtcgtggactggcggcgcaggatgacctaaaaatggtccacgaactggcggcggtgctgaatgctgaagtcggctgttcacgtccaattgccgaaggcgagaactggatggagcgtgaacgttatatcggtgtctccggcgtgttgctgaaatccgatctctacctgacgctggggatctccgggcagatccagcatatggttggcggcaacggcgcaaaagtgattgtcgccatcaataaagataaaaatgcgccaatcttcaactatgccgactacggtctggtgggcgatatctacaaagtcgtccctgccctgattagccagttgagccgctaattcccctttcaaccacatctcccgctgtaaacgcagcgggaagggagcataacgcatgtcggatgacaaatttgatgccattgtggtcggtgcgggcgttgctggtagcgttgccgcactggtcatggcacgagccgggctggatgtcctggtgatagaacgcggcgacagtgccggatgtaaaaacatgaccggcgggcgtctttatgcccacacacttgaagcaatcattccaggctttgcagtatcagcgccggtagaacgcaaggtcacacgcgagaaaatctccttcttaaccgaagaaagcgccgttaccctcgattttcaccgcgagcagccagatgttccgcaacacgcatcttataccgtattgcgtaatcgtctggacccgtggttgatggaacaagccgagcaggcgggcgcgcagtttatcccaggcgttcgcgtcgacgcgctggttcgtgaaggaaacaaggtcactggcgtgcaggctggggatgatattctcgaagcgaatgtggtgattctggctgatggcgttaactcgatgcttggccgctcgctgggaatggttcccgcttccgatccgcatcattacgctgttggtgttaaagaggttattggcctcacaccagaacagatcaacgatcgctttaatattacgggcgaggaaggtgccgcctggctgtttgccggttccccttctgacggcctgatgggcgggggatttctctataccaacaaggattccatatccttggggctggtttgtggattgggtgatatcgcccatgcgcaaaaaagcgtgccgcaaatgctggaagattttaaacaacaccccgccattcgcccgctgattagcggcggcaaactgcttgaatattccgcgcatatggtgccggaaggcggtctggcaatggtgccgcaactggttaacgagggcgtgatgatcgttggtgacgccgcaggcttctgcctgaatttgggttttacggtccgcggcatggatttagccattgcatcggctcaggctgccgccacaacggtgatcgccgccaaagaacgcgcggatttctccgccagcagtctggcgcaatacaaacgtgagctggaacaaagctgcgtcatgcgtgatatgcagcattttcgcaagatcccggcgctgatggaaaacccgcgcctgtttagccaatacccacgaatggtagccgacatcatgaacgagatgttcaccatcgacggcaaaccaaaccagccggtacgaaaaatgatcatgggacatgcgaagaaaattgggctgatcaacttgctgaaagatggcattaagggagcaaccgcgctatgagccagaacgctacggttaacgtcgacatcaaattaggcgtcaataaattccatgttgatgagggccacccgcatatcattctggcggaaaatcccgatatcaatgaattccataaattaatgaaagcctgccctgccggactttataagcaggatgacgcaggaaacattcattttgattccgccggttgtctggagtgcggcacctgtcgggtgctgtgcggtaacactattctcgaacagtggcaatatcccgcaggcaccttcggtattgattttcgctacggctaatcatgcatcccacaggcccgcatctcgggcctgatgttctgtttcgagagtccaacatgaaagtgacattaacgtttaacgaacaacgtcgtgcggcgtatcgtcagcaagggttatggggcgatgcttcgctggccgattactggcagcagaccgctcgtgcgatgccagacaaaattgccgtggtcgataatcatggtgcatcgtacacctatagcgcgctcgatcacgccgcgagctgtctggcaaactggatgttagcgaagggtattgaatcaggcgatcgcatcgcatttcaactgcctggctggtgtgaatttaccgttatctatcttgcctgcctgaaaatcggtgcagtttccgtgccgctgttgccttcctggcgggaagcagaactggtgtgggtgctcaataagtgtcaggcaaaaatgttctttgcaccgacgttgtttaaacaaacgcgtccggtagatttaatcctgccgctgcaaaatcagcttccacaactacaacaaattgtcggcgtggacaaactggctcccgccacctcttccctctcattaagtcagattatcgccgacaatacctcactgaccacggcgataacgacccacggcgatgaattagctgcggtgctgtttacctccggaaccgagggtctgccaaagggcgtgatgctaacgcataacaatattctcgccagtgagcgggcttattgcgcgcgactgaatctgacctggcaggatgtctttatgatgcctgcgccacttggtcacgcaacgggctttctgcatggcgtaacggcaccattcttaattggcgctcgcagcgtgttgttagatattttcactcctgatgcgtgtctcgcgctgcttgagcagcagcgttgcacctgtatgctcggcgcaacgccgtttgtctatgatcttttgaatgtactagagaaacaacccgcggacctttcagcgctgcgtttctttctttgcggcggaaccacaatccccaaaaaagtggcgcgtgaatgccagcagcgcggcattaaattattaagtgtttatggttccacagaaagttcgccgcatgcggtggtgaatctcgatgatcctttgtcgcgctttatgcacaccgatggttacgctgccgcaggtgtagagattaaagtggtcgatgacgcacgcaagaccttaccgccaggttgcgaaggtgaagaagcctcgcgtggccccaatgtgtttatggggtattttgatgaacctgaattaaccgcccgtgccctggatgaagaaggctggtattacagcggcgatctctgccgtatggatgaggctggctatataaaaattaccggacgcaaaaaagatattattgtccgcggcggcgaaaatattagcagccgtgaagtggaagatattttattgcagcatcctaaaattcacgatgcctgtgtggttgcaatgtccgatgaacgtttaggtgaacgatcatgcgcttatgtcgtgctgaaagcgccgcatcattcattatcgctggaagaggtagtggctttttttagccgtaaacgggtcgcaaaatataaatatcctgaacatatcgtggtaatcgaaaaactaccgcgaactacctcaggtaaaatacaaaagtttttgttaagaaaagatattatgcggcgtttaacgcaggatgtctgtgaagagattgaataagtttcatcttcggggatcacataaccccggcgactaaacgccgccggggatttattttatttcttcagttcagccaggcttaaccaggtttgcaccacggtgtccgggttcagagacaggctatcgatcccctcttccatcaaccatgcggcaaagtcttcgtggtcggacggaccctgaccgcaaatcccgacatatttgccctgtttcttcgcggcacggatagccatcgacagcagtgctttcaccgcatcgttgcgctcatcgaacaattcagacaccacgccggagtcacggtccagaccgagcgccagctgcgtcatatcgtttgagccaattgagaagccgtcgaaatattcgaggaactgctcggccagcaaggcgttggacgggatttcacacatcatgatgattttcagcccgttctcgccacgtttcagcccctgacgcgccagttcttcaaccaccgctttcgcctgatctacggtacgcacgaacgggatcatgatctcaacgttggtcagtcccatgtcgttgcgcacacgtttcactgcttcacactccagcgcgaaacagtcgcggaagctgtcggaaacatagcggcccgcgccacggaagccgagcatcgggttctcttcatctggctcgtaacgctcaccaccgaccaggttggcatattcgttcgatttaaaatcagagagacggacaatgacgcgcttcggataaaacgcggcacccagcgtcgcgatcccttcagtcagacgaccaacgtaaaattcacgcggagaatcaaaacctttcatcatctcgcggatttcgttttgcaactgcggttcctgatcgtcaaactcaagcagtgcgcgtgggtggacgccaatcatacggttgatgataaattccagacgcgcaaggcccacgccttcgttcggtaggcaggcgaagtcgaaagcacggtccgggttaccgacgttcatcatcactttcaacggcagatccggcatcgtttctacgctggagcttttcacgctaaattccagcaactccgcatagacgtaaccggtatcaccttcggcacaagaaacagtgacgttctcaccgtctttcatccgttctgttgcatctccacagcccactaccgccggaatgcccagttcacgagcgatgatcgccgcgtgacaggtacgaccgccacggttggtgacgatggcagatgctttcttcatgatcggttcccagtccgggtcggtcatgtcagtaaccagcacgtcgccaggttcgatgcggttcatttcgctgatgtcatggatgactttcaccggacccgcaccgatgcgatgaccgatagcacggccttcggcgataatcttaccctgtgaatgcagcgtataacgctccatgacctgaccgcgtgagcgcacggtttccggacgcgcctgcacaatgaacagtttaccggtgtggccatctttcgcccactcaatatccatcgggcgaccgtagtgtttctcaatttgtacggcctgttttgccagttcctgcacttcttcgttggtcagcgagaagatgtcacgctgttcctgcggtacgtcttcgattttaacctgcttgccgtgctcctgggtcggcgcgtaaaccatgcggatttttttcgaccccatggtgcggcgcacgatagccgggcgattcgccgccagtgtcggtttatgcacgtaaaactcatccgggttaaccgcaccctgcacgaccatctcaccaaggccccatgcggaagtgataaacaccacctggtcaaagccggattcggtatcaatggagaacatcacgccagatgatgcgaggtcagagcgcaccatccgttgaacaccggcggagagcgccacaccacggtgatcgtaaccctggtgcacacgataagagatggcgcgatcgttaaacagagaagcaaatacatgtttcactgccacgagaacggcgtcaaaaccctgaacgttgaggaaggtttcctgctgaccggcaaaagaagcgtccggcatatcttctgcggtggcggaggagcgcaccgcaaaagaggcgttttcgtcatcggcggaaagctgtgcataggcttcgcggatggcgttttccagctcaggctggaagggagtgtcgataatccactggcggatttgcgcgcccgctttcgcaagctgagtaacatcgtcaatatccgttttatccagcagttcataaatgcgctggtttacgccgctttggtccagaaactggttaaacgcgtcggcggttgtggcgaaaccattcggaacggaaacacccattccggaaagattagtaatcatttcacccagggaggcatttttgcccccaaccctgtctacatcattcatgccgagttggttataccaaagcaccagcggtgacgagccattgttggacatcgaacaatccttttgtgataaatgaacggtttgagaaacacatttctgcgcatttatctttgcatatttaaccggatgaaaaaaacggtgaatcgttcaagcaaatatatttttttactttttaagactgatcccagcgttgcgcaaatctgctctcttcgacaatttccacataaaccatcggtataaacgaaaccataaaaatgaaatgctgttttcataaaaaataaaattgaaggttcattttataaaccagacataacgttctacgcttctgtgcgtttttaatttatgctttcatagaattatgtctgcatcacgggaagaacaaaatggataatgctgttgatcgccacgttttttatatttctgatggtacggcaataactgcggaggtattaggacacgcagtaatgtcacaatttcccgtcactatcagcagcatcacgctgccgtttgtcgaaaatgagagccgtgcacgggcagtgaaggatcagattgacgcaatttatcaccagacaggcgtgcgcccgctggtcttctactccatcgtgttgccggagattcgcgccatcatcttgcaaagtgaaggcttttgccaggatatcgttcaggcgctggttgccccgctacaacaagagatgaaactggatccaacgccgattgctcatcgtacccatggccttaaccctaataatctcaataaatatgatgcgcgcattgcggcgattgattacaccctcgcccacgatgacggcatttcgttgcgcaatctggaccaggctcaggtgatcctgctcggtgtttctcgctgtggtaaaacccccaccagtctgtatctggcaatgcagtttggtatccgcgcggcaaactacccctttattgccgacgatatggataatctggtgctacccgcgtcgctcaaaccgcttcagcataaattgttcggcctgactatcgacccggaacgtctggcggcgattcgcgaggaacgtcgggagaacagtcgctatgcctcgcttcgtcagtgcaggatggaagtcgcggaagtggaagccttgtaccgtaaaaatcagatcccgtggattaacagtaccaattattcggtagaagagattgccaccaagatcctcgatatcatgggccttagtcgccgaatgtactagagaactagtgcattagcttatttttttgttatcatgctaaccacccggcgaggtgtgacacacctcgcacttgaaatcagcagcgattggtttatcgtgatgcgcatcacttcccggcagtcctgccgtagaagcaacaaatttctgagacttgtaatgaacagaactgacgaactccgtactgcgcgtattgagagcctggtaacgcccgccgaactcgcgctacggtatcccgtaacgcctggcgtcgccacccatgtcaccgactcccgccgcagaattgaaaaaatactgaatggtgaagataagcgactgttggtcattattggcccctgctcgatccacgatctcaccgctgcaatggagtacgccacccgtctgcagtcgctgcgcaaccagtaccagtcacggctggaaatcgtaatgcgcacctattttgaaaaaccacgaactgttgtcggctggaaaggactaatctccgatccagatttaaacggcagctatcgggtaaatcacggtctggagctggcgcgcaaattacttttacaggtaaatgagctgggcgtcccaaccgcgaccgagttcctcgatatggtgaccggtcagtttattgctgatttaatcagttggggcgcgattggcgcacgtactaccgaaagtcagatccaccgcgaaatggcttcggcactctcctgtccggtaggttttaaaaatggtaccgatggcaatacgcggattgctgtggatgctatccgcgcagcccgcgccagccatatgttcctctcgccagacaaaaatggtcagatgaccatctatcagaccagcggcaacccgtatggccacattattatgcgtggcggcaaaaaaccgaattatcatgccgatgatatcgccgcagcctgcgatacgctgcacgagtttgatttacctgaacatctggtggtggatttcagccacggtaactgccagaagcagcaccgtcgccagttagaagtttgtgaggatatttgtcagcaaatccgcaatggctctacggcgattgctggaattatggcggaaagtttcctgcgcgaaggaacgcaaaaaatcgtcggcagtcagccgctcacttacggtcaatccattaccgacccgtgtctgggctgggaggataccgaacgcctggtcgaaaaactcgcctctgcggtagatacccgcttctgaatgcgtgcccattcctgacggaatgggcatttctgcgcaacttgttgtcttctcaacaaattactgcttgctctggtcagccataatattgataataagaatcattgttatatcaattattattaatttttatgcgttatacggatagcagaaaactcacgcctgaaacggatgccaatcacaagaccgcttccccgcagcctattcggcgaatttccagccagacactgttaggtccggatggcaaactgattatcgatcatgacgggcaagaatatctgctccgtaaaactcaggctggcaagctgctgttgaccaagtagcctttaactcgagcagctgacttccagccgtttaccccagtcaggtggacgactgacatagtcatcatctctgtcgctgaaaggatttcgcaacgcctcatgcaggcggtgcaattccgtcatatcacccttttctgccgcttcaatcgcccgttgcgccaaccagttgcgcaataccagagcggggttaacgctttgcatcagttgctgacgctcactatcgctaacctcgtcttgttgcaaacgcccccgataacgggcaaaccagtcatcaaatgccgcacgatcaataaactcatcacgtagcggtgacgccgcgctgtgctgctcggtcagactcagcatgcggaatgtgcgggtataatcgctgcgctctcgcgccatcagactgaataattcattcagtagcgcgttatcctctttttgctccgtcatgaagcccagtttctgccgcatccgttctccataatgcgtcaacaaaacctgctgatagctgtccagggcctcattcagggcatctacggcaacaaatggcgacaatgtctgcgccagacgctgtaaattccacaacgcgacggcaggttgattatcaaagctgtaacgcccttgatgatccgagtgattacaaataaaaccgggttcgtaatcatcaagaaaaccaaacggcccgtaatcaagcgtcagccccagcagcgacatgttgtcggtattcatcaccccatgagcaaagccgaccgtctgccattgggcaattaacgacgcggtacgtgcgacaacatcgctaaaccagagacggtatttgtcctcatcatctgcaagatgtgaccagtaatgacgaatagcaaagtcagctaactgacgaaccttttccgactcgcggcggtagtaaaaatgttcgaaatgaccaaagcgcagatgacttggtgccacacgcatcagcatcgcgcctggctccgccgtttcccgatacactggcgaatcgctggtgacgatacttaacgcgcgggtcgtcggaatgcccagataatgcatcgcctcactggcgagactttctcgtatcgtcgaacgtaaaaccgcccgtccatcacccattcgcgaataaggcgtcaggccagcacctttcagatgccagtccattgtagtgccatcagcaagcagttgttcgccgagtaaaatgccgcgcccatcacccagttggcccgcccagacgccgaactgatgaccactgtaaacctgcgccagtggtgacataccaggcagtagggcttcgccgccccagacacctgcgccatttttaaacagcgacgatggaatactcagcgtgttagccagttcggtattatgccaaatcagccgggcattatttaaaggcgtaggggaaagtgctgtataggtttctggcaattcatcgcgccagcgggtaacaaaagacagggtcatagatcctcctgtttgatagtgtagacggttactctcgtcttaaacaccagcaaacagaagggttatcgctgaaccaacgtcgttatctgatttatgggaacggcaggccacaggcatccctggagagcatggaaatcgaagggggtaatctgtgccaatatttctgccgtatcaatgcctcccgcaatgatgcaattgcaacaaggggaaatttgcgcctggatcgcacgaataaacggttcgaaggagcggtgcgtgatttgttgctgaataaaacttttatccagcatgacgcgggtgaaaagaccatcaaaaaccgctttcattgtgctattgcctgctcccaaattacctaacacaaggggatacacttgcgataaggataaaagaccgcgattatcttttccttcattgagatgcgggtaattctcattaatcaacagttcaataaacggatattttaatagttcgcctgcgtaattatccctctctaataataatgtagccacttgtggcgttaaattaagccaggcaaagagtttatgttgaataaaaaaatgttggcatgattttagtaattccaactgctctgaaaataattgccaatgttgctcctcggtaagttgcgctataacccgactcgtcgggatacgaaccgtaccatcttcactggagaaatgggtaattaactcaacgccgacaaggacttgctggttgtctcttatcggcaggaaatagcaatcagaatgataaagattctccaaaaaaatcttcatggtaaccgtccctctcgaaggatgtttttcagtatccggctaaaagggatgaggccataagacataacaattacagaaggagtaactttcatttgttccatgttaaccactttttcaggggtcctttttttagattatcctgattataaacgaataatccatttacggaatttttgtctgcaaaatactactgtattcaggagtaaatggacggcgatgtatcatcgccgtccatttttcgacatactagattcgtctcgcctgccagaaatttttctgccaatagacattatcaagtgaggaacgcatcactcccttgctggtagaggcgtggataaattggttgttggtatcgtaaatacctacatgcaaaccattttgtccggaccccgttttgaaaaagaccaggtcacctggcagcaactcgtctttatcaatttgcgtgccaatagaggcttgttgtttggtttcacggggcagctgcaaatcgaaacgatcgcgcatcgtcacaaccacaaatcccgaacagtccacaccgcgccgcgtcatgccaccataacgatacggcgtgccatgccagctttgtagctggtcgttcaaaccggcaataacggtaatcgaatcagaaagtctggcatttggcggcggtgctttatggtggctacacccggccagaagcagtgctgtgatcaaaataaggcagaaacgcattccgtacggttcctctgttttttattcttgcattaatttagcgtcgtaattacccgattttcaagatactaatgaaatcagatggtcgaaatcagcattctgtgaccttcgatatccagacggcgaaaattcatcccataggcctgcgccagatttggcggcgtgagcacctcttccctgcgtccactggccagcatttttccaccttttagcaaccacgcccgatgcgcatgacgcaatgtgtggttgagatcgtgactgctcatcacaatcgccagtccttgctgacacagcgcgctcagaattttgtctaacgcactttgttgcgcaacatcaagactgttcatcggctcatcaagaagcagcaattggcctgcgggattggcttgtggtgtgatttgcaacaccaccgcagcaagacgtacgcgttgccattcaccgccggaaagttgattggtgctacgtccgagtttgtcatcaagagccagcgcccctgcgacatcattcagtagttcggtacgcgttttatcgtgctgatgcagtgtcaggtagtgccagaccggcgttgcaaacggcggcgtctgctgttgtgaaagataggcgcgatgcagcgcgagttttgttgcggaccatgcttccagtggttgccccgcgaactgaatgcttcccttaccgctggtcattccggccattcgcgccagtaaggtactcttacccgcgccattcggccccaccaggtgcaggatctccccagcccgaacctcgccagaaagcggccccaggcgggtagattccgcaacatcttgtaactgcatcacaatagacattattttgccaacgccagtttaatgctttccatcacaatgggatcttccggcgtcatatccggggaaaaacgctggatgacttttccgtccctgccaaccaggaatttttcaaaattccataaaatatcatccgggtacagcggtgcacggcctttgctgaccatacgggcatagaatccgctctcttccggcgcgactgcggtcggcgctgcggcaatcaatttttgatacagcggatggcgtccttcgccattaacttcaatcttactgaacatcgggaacgtcaccccccatgtggtggtacagtaagttttaatctcttcatcgctgcccggttcttgttccagaaactggttgcacgggaatcccagcaccataaaacctcgatcgacccaggctttctgaatattctccaactgctcatattgcggcgttaagccacactttgaggcgacattgacaatcaacagcacattaccggcgaacttctccagcgtggtcacttcaccgtcgatatctttcactacggtcgtcagaatggaatcttgcatcgtttctcctgggtgtggtcagtaaaaatcttagcttttaatcatagaccgtctttttgcggctaacgtcctgcttttaacaataaccagataaacaccggcgcacctaacgttgcggtgaccacgccaataggcagctctgcggcagctaatgccaggcgcgctacaatatcggccagcagcaatgcgctcgcccctgccagcgcgcagccgggaagtaatacgcgatgatcggttaaaccacacaaccggagaatatgggggatcaccagaccaataaagccgatagcacccgccagcgccacactgacgccaaccatccagccggtcgctgccaccagcacattgcgccagaaccacaggggtaaacccagttgccgcgccgagatctcgccaagtgctaacatattcatcggcctggactgacaacagatccacaacaacacggggatcaatgccagcatcagccagctttgccgccagtctacgccgccaaaaccgcccatcatccagtacatcagctgacgcaaatcaactgaggtggaaaagtagatagcccacgtcattagtgcgctacagataatccctaatgcaacgccagccagcaataaccgactggtcgaaagatgacgacgggcgaaacgtaagagtattaaagtgatgataagcgcgccagcaatcgcacacagccctagcgcccagttggggagttgcccttgcccaagcaataccgcggcgataagccccacgcctgcgccgttagagacgccaagtagtccaggttctgccagaggattttcaaacaacgcctgcattacagcgccggatatagccagcgccgcaccaaccagcaatacagccagcgtacgtggcaggcgaatttgccagacgaacagttcgccacgaggagtaaaccagtcacctggcgagatccattgttcaccggcgcaaaggcttaagagaagcgccagcagcatcaaaactgacaggcataataaccagcgaatattttgtcgctgttgttggcgggcaagtgtcagcatggtatccgttctgctgaagtgtcatggcgttgattttacggtgactcttcgacagtgaaaagaaaaaaggccgcagagcggcctttttagttagatcagattactcgtctttgggcgaagcgttttcgacccggctttttaacttctgcccgggtctgaaggtcaccacgcgccgtgctgtaatgggaatatcctcgcccgttttcgggttacgtcccgggcgttgattcttatcacgcagatcgaagttaccaaaaccagagagtttcacctgttcgccgttttccagagcgcgacggatctcttcgaaaaacagttcaaccagttctttggcatcccgcttgctaagcccaagcttatcaaacagatattctgacatttcagcttttgtaagcgccataggttcaatccctcaatgatgcctggaatcgctcttttaatgcctctacacatttggcgacggtagcggcaatctcctcttcttcgagtgtacggctggtatcttgcaggatcaggcttatggcgaggctcttatacccctccgcaacacccttaccgcggtacacgtcaaataagtttacgccaactacctgatttacgccaactttcttacattcggataaaatatccgctgcgggaacgttttctgcgaccaccaccgcgatgtcacgacggttcgccgggaagcgagaaatctcgcgcgcctgaggcaccacgcggtctgcgagcttgttccactccagttcgaacaccagagtgcgaccgttaagatccagtttacgttccagttcaggatgaacaaccccaacaaaaccaatacgttcacctttcagataaatcgctgcggattgccccggatgcagtgccggattcgcttctgcacggaactcaacctcattcagtttaccggtcaggtcgagaacggattcaagatcgcctttcaaatcatagaaatcaacggtctcttttgccaggttccagtgctcttcgtaacggttaccgcaaatcacaccggctaacatcagatcctgacgaatgcccaacggtgcctgagtatctggtacgaaacgcagaccgctttcgaaaatgcgcacacggttctgctgacggttctggttgtacaccacggttgccagcaggccagtccacagagaaagacgcattgctgacatttcaacagagatcgggcttggcagcagtaaggcttcaacgcctggatggatcatctgctgcactttcggatcaacgaagctgtaggtgatcacttcctgatagcctttgtcgttgagcagcgttttcacgcgcttgagcgacaggtcagcttcacggtgagtacccataatcaggcttgcctgtaccggctcatccgggatgttgttgtagccgtaaacacgcgcgacttcttcaaccagatcttcttcaatctccatatcgaaacgccagctcggcgcaactgcctgccattcgtctttgccttcggtcacttcgcagccgagacgacgcagaatgtcagttacctgctcatccgcaatatgatggccgatcaggcgatccagtttgctacgacgtagagtgatggttgcacgcttcggcagcgttgcttcgttggtgatatcaattaccgggccagcctcaccaccgcagatgtcgatcagcagacgggtcgcacgttccatcgctttgtgctgcagtgccggatcaacgccacgctcataacggtgagacgcatcggtatgcaggccatgacgacgagcacgaccggtgatagacagcgggctaaagaacgcgcattccagcagcacgttttgtgtttcgtcattcacgccagagtgttcgccaccgaagatgccgcccatcgccagcgccttgttgtggtcggcgatgaccagagtgtcagcattcagcttcgcttcagtaccgtcgagcagcaccagcgtttcgccctctttcgccatccgcaccacaatgccgccttcaatgcgatctttatcgaaagcgtgcatcggctggcccagttcgagcagcacatagttggtgacgtcaacaactgcatcgatagaacggatcccgcaacgacgcagtttttctttcatccacagcggagttggcgctttaacgttaatgccttttaccacacggccaagataacgcgggcaggcttccggcgcttcgactgtaatcggcagcgtgtcgtcgatggtcgcaccaaccggaacgatttccggttgaaccagcggcagctggttcagcacggcaacgtcacgcgcaacaccaatgatgcctaagcagtcggcacggtttggcgtcacgctgatttcgatggtgttgtcatcaagtttcaggtattcacggatatcggtgccaatcggcgcatccgcaggcagttcgataatgccgctgtgatcgtcagaaatgcccagttcagagaaggagcacagcatcccttcagacggttcgccacgcagtttcgccgctttaattttgaaatcacccggcagaacagcaccaatggtcgctaccgctacacgcaggccctgacggcagtttggcgcaccgcagacgatgtccagcaggcgatcgccgccgacattcacttttgtcacacgcagtttgtcagcgttcggatgctgcgcacactcaaccacttcaccaacgaccacgccgtggaagctgccggcaaccggttctacaccgtcaacttccaggcccgccatagtgatttgatttgccagcgcatcgctatcaatcgccgggttcacccattcgcgtaaccacagttcactgaatttcataatctattcctgccttatttaaactgtttgaggaaacgcagatcgttttcgaagaatgaacgcaggtcggtgacgccgtaacgcaacatagtcagacgctccatccccatcccgaaggcgaaaccagagtaaacttccgggtcgatgccaacgttacgcaacacgttcggatgcaccatcccgcagcccagcacttccagccatttaccgtttttacccatgacgtccacttctgcagaaggttcggtaaacgggaagtaggaaggacggaagcgaatctgcaaatcttcctcaaagaagttacgcaggaagtcgtgcagcgtgcctttcaggttggtaaagctgatgttggtatcaacaatcagaccttccatctgatggaacatcggcgtgtgagtctggtcgtagtcgttacgataaacacggccaggcgcgatgatacgaatcggtggctgctgggctttcatggtgcggatctgtacgccagaggtctgggtacgcagcaggcgggtagtgtcaaaccagaaagtgtcgtggtcagcgcgcgccgggtggtgaccaggaatgttcagagcatcgaagttatgataatcgtcttcgatttccggcccggttgccacggtaaagccaagctcaccgaagaaactttcgatacggtcgatggtacgggtaaccggatgcagaccgccgttttcaatgcgacgacctggcagagagacatcaatcgtttccgccgccagacgcgcattcagtgcagcgctttccagttccgctttacgcgcattcagcgcctgctgaacctgctctttcgcttcgttgataaccgcaccagctgccggacgctcttctggcggcagctcacgcagggtcgtcatctgaagggttaagtgcccttttttacccaaatattcgacgcgcacattatctaacgcggcaacatctgacgcctggctaatggccgccttcgcactggcaaccagttctgcgagatgtgacatggttttcctcattgtgtcagtggtgacactggttcgttggacttagagcctatcccatcaggctattttacttgccattttggtcccgggctgtgctcgaaattctcacgtacttaaatacgctccggtttctccgcgctggccgtgtccagtctggctgcgacaattacacctgatgagacaggctttttatttttcaaaacgcgcatacaaaaaaagcctccactgggaggctttcaggcgctgttttccgtttctcttctcacgcgctagcctcctggattcaggtgctaaagtaaaaaaagaagcggaaaatagcagcattcattgcttgcgttaccttttggtactcttcaaaagacctttattgaaaaggctacggcgataaaagtcaatgttttgatggcgttgaaacgaaaagagggagactagctccctctttcaactggcttatgccagagctgctttcgctttttcaaccagagcggtgaacgctactttgtcgaatactgcgatatcagccaggatcttacggtcgatttcaacagaggcttttttcaggccattgatgaatttgctgtaagaaataccgttctgacgtgctgctgcgttgatacgcgcaatccacagttgacggaactgacgcttacgttgacgacggtcacggtaagcatactgaccagctttgataacagcctggaaggcaacgcggtatacgcgagaacgcgcaccgtagtagcctttagcttgtttcaaaattttcttgtgacgtgcacgtgcaataacaccacgttttacgcgagccatatgtgctctcctgtatctatattctaattaaaaagttaaaaacgttaacggcttatgcgtacggcaggcacgcgattaccaggcccagatcgcctttggaaaccatggctttcggacgcaggtgacgtttacgtttggtcgcttttttggtcagaatgtgacgcaggttagcgtgcttgtgcttaaaaccacctttaccggtttttttgaagcgcttagcagcaccgcgtacggtcttaatttttggcattttaataacttccacttcgcattgttaataaacgaaacaaaggcgaacaaagcctgtgaagcccgaaggctccacagacagtgctacttgaaggccttactgtttcttcttaggagcgagcaccatgatcatctggcggccttcgatcttcgttgggaaggattcgaccactgccagttcttgcaaatcgtctttcacgcgattaagcacttccataccgatttgctggtgcgccatctcacgaccgcggaaacgcagcgtgattttggctttatcaccctcttcgagaaagcgaatcaggctgcggagttttacctgatagtcgccttcatctgtaccaggacggaatttaatttccttaacctggataactttttgctttttcttctgttccttagaagacttgctcttttcatagaggaatttgccgtaatccattatacgacaaaccggcggctcggcgttagggctgatctcgactaagtctactccggcttcttctgctttctccagagcttctctcagactcacaataccaagctgctcgccttccagacctgttaagcgaacttcctgggcgcgaatttcgccattgatacggttagggcgcgccgtttgaactcgttttccgcctttaataccttattcctccaattgtttaagactgcggctgcgaatctcttgttgcagcttctcgatcacttcatttacgtccatgcttcccaggtctttaccacggcgggtgcgaacggcaactttgcctgattccacctctttatcaccacagaccagcatatatgggacgcgacgcaaagtgtgctcgcggattttaaagccaatcttctcatttctcaagtctgctttaacacgaatgcccgcatttgatagtttttgcgtcaattcgttaacgtattcagactgtgaatcggtaatattcatgataacaacctgaaccggcgcaagccaggtcgggaagaaaccagcgaactcttcggtcaggataccgatgaaacgttccatcgaccccagaattgcgcggtgaatcattaccggtactttacgttcattgtcttcgcctacataagaagcgctcagacgagacggcaaagagaagtccagctgtactgtaccgcactgccatgcacgatcgaggcagtcatacagggtaaattcaattttcggaccgtagaaagcgccttcacccagttgatattcaaacgggatgttgttttcttccagcgcaaccgccaggtccgcctcagcacgatcccacatttcgtcgctgccaatacgtttttcaggacgagtggagagtttgacgacgatcttctcgaagccaaaagtgctgtacatatcatagactaaacggatacatccgttaacttcatcgcgaatttgttcttcagtacagaagatatgcgcgtcatcctgggtaaatccacgcacgcgcatcaggccatgcagcgaacctgacggctcgttacggtggcagctaccaaactcggccatacgcagcggcagatcgcgataagacttcagcccctggttgaaaatttgtacgtgacccgggcagttcatcggcttaatgcagtattcacggttctcagaagatgtggtgaacattgcatctttgtagttgtcccagtgaccggttttttcccacaggacacggtccatcatgaacggacctttaacttcctgatactggtactctttcagtttagaacgaacaaacacttccagttcacggaagatggtccagccgtcgttgtgccagaataccatacccggcgcttcttcctgcatatggtacaggtcgagctgtttaccgattttacggtggtcgcgtttcgcggcttcttccaggcgctgcaggtaagcgttaagtgcttttttgtctgcccacgccgtaccgtaaatacgttgcaacattttgttgttgctgtcgccacgccagtaagcccctgccgttttcattagtttgaaatgatggcagaaacgcatgttcggtacgtgcggaccgcggcacatatcgacatattcttcatggaagtacagacctggcttgtcatcatgggcgatgttttcgtcaagaatggagactttgtagctctccccacggttggcgaaagtttcacgcgcttcgtgccagctgactttcttcttaatgacgtcgtagtttttctcagcaagctcatgcatccgcttctcgagtgcttcgacatcttcctgggttaacgtgcggtcaagatcaacgtcgtaataaaaaccgttgtcaataaccgggccgattgccattttggtatgcggccaaagttgtttaatcgcgtgccctaacaggtgcgcacaggagtgacgaatgatctccagaccttcttcgtctttggcggtaatgatcgacagttgtgcgtcgttttcaatcagatcgcaagcatcaaccagttcgccattaacgcgccctgcgatacaggctttcgccagacctggaccaatgtccagcgcaacatccatggggcttacagcgtgatcgtaatggcgttggctgccatcaggaagagttataacaggcattttatatccttatttgcagtggtgacccacacgaaagatcacatacaaagaaaaatttgtttattaacagttcattgcgaaaccatctagccaacaaatgctaaattggttcgcaatcaggtacacaaatgaaagacattaacctctcaccttccacccggttgagcgatgttaacactaaaaaaagggagattgtacctttccgtttcacattgattcgattcgcaattcgtttgtagtgagtacaccagcaaaacgcttaaagaacaactgataacatcacggtgcgtctgaaaggtttactgcgagcggatttacagcagcataaactgaatccagcaaagttcgttgcgtgatttggcggtagtattttaaacgctcatgagattaatgacgaagtggtcatatcacaatgataaaagtgacacaattcttataacaatttttcgtgcacatttcgttctggcgataataattaatcatcatcctcaaaacctccagatatatataaggcgaacagattatgagtcaaaacgatatcattatcagaactcattataagtctcctcatagattgcacatcgatagcgacataccaacaccttcatcagagcctattaatcaatttgcgcgccagctcatcaccctacttgatacctctgacttaagttcgatgctgtcatactgtgttactcaggaatttaccgcaaactgtcgaaaaatatcacaaaattgttattccactgccctttttaccattaactttgccacttcacccatccatacagaaaatatactcattacattacactataaaaaagaaatcatttccttattactggaaaccacgcctattaaagctaaccatttgcgaagcatactggattatattgaacaggaacagttaactgctgaagatcgtaaccattgtatgaaactgtctaaaaaaatccatagagaaaaaaactatacacccaacagtaaatctcaatggtagtgcatgttttttgcaatctccttctgacgctattttttgtcgccatctgtcattgcaatacgcccttgattcattgagaaatggaaaaggcaaagtcaacctgattaaacattactcctccgttgaatccatacagcagcatgtccccttagtccgggacgcggagttcagagcattacttcgccatcctcctgcagggagtcgcgttatcgcgagtaaggattttggcttcgctttagatattttcttttgtcgaatgatggcaaacaatgtcagtcatatgtccgcgattttatatatagacaatcatactttgtcagtaaggctacgaataaagcagtcagtgtatggacaattaaattatgttgtgtccgtttacgacccgaacgataccaacgttgccgtcagagacacccacaggacagcacggggctttctttcgcttgataagttcatcagttcaggtcccgatgctcagacctgggctgatagatatgttcgcaactgtgcaattgctattctgcccctattacctgtgggagttccaggggctattttcgcgggtattgcatcacgaatgccatttgcccctatacatccatcggcaatgttgttaataatggctacaggccagtctcaacagcttattacattattcaaacagttgcccatactccctgaaaaagaaatcattgaaataataactgcgcagaatagcgttggtacacctgctttatttttggctatgatgaacggacatactgacaacgtgaaaatatttatgcaagaaattcagtcactggtagataatcacatcattcatgaagataatctggttaaattactgcaaactaaaagtgctaacgaaacacctggactttatatctccatgttgtatggattcgatgaaataatcgatatctttctgaatgcattaaccactccaatagcacaagagcttttaaacaaaaaactggtgatgagtattttagccatgaaaatacatgatggtgagccaggattatacgccgcaatggaaaataatcaccctttgtgtgtcacacggttcctctctaaaattaatggcatcgcctttaaatacaagttgagcaaagctaacatcatggatttattaaaaggagctacagcacagggaacccctgcattatacatcgccatgagcaagggtaatgaagacgtcgtgttatcttatatatcgacgctgggtgcttttgcaaaaaaacattcttttagtcaacatcagttatttacactattggccgctaaaaatcatgacaacatgtcagctgttcatatagccattcatcataagcattataaaactgtagaaacatattatgctgctattaatgcaatcagccaaagcctgagttttagtgctgatgaaataaagacgtatttataaccagctatttacgatatatatcgatacataattttatttttttcataaaacgcagaaacagtgaccatgtgcacaacgccacccgacggctgtaataacaaaaaatcccttgatgcctgtcccttttgttacactccgttatcacgcacaagagatatgcaggacactggtatgccgactaaacgctttgataaaaaacactggaagatggtggtggtgctactggcaatctgtggcgctatgttgttgctacgttgggcagcaatgatttggggctgagcagtgacaaacgaagacagccagaccgcataacacggtccggcagataattttacatgctgtagcccagcgataaggttgtccgacggtcggtatgttccggtgcagactctggaggttcagagttccatgtgacgttgtaagccaccttcagtccaaaatgttcattaatagcaacatttaatgcgctttcggagttcagcgttgtgtcttccgcgccaaagaccgaaacaccctgcgtaaatttagcgttgtcagtcaactgccatgcataagccccggaggcatagcccagcggctgggtttcactggcattgtcggtatatttgtcgtaacgcacacctggaccgaattcaaagcggaaactgtgtaccgggccattcaaaaactgacgaccataacccgcggtcaacacatcgcgctctcgatagccgttataacggtctgtcagccagcttgcctgaccaaataaatagtcataatcagttaaattaaaacggctacgcccgcccgccgcatatttttctgaagaacgctcatcattagaagaagtattactggcgttcccccacagcgaccaggcagtggtgtgtccataccaggtcatggtggtgtcagccgtaagtgaggagcttttcgtattgcctgattgtgcaagatatcctgcgttcagattaccttcgaaaggttttttagcgctggcaggatcatccatgacagtaaaaacggaatcatcggcagctgcattcagtgacgcaaacatgccccccgccaacataacgatggcaggaactgtcttcaaaagcttcatttatcaagagtccgtacaacaaaaaaagagaccatcgcggtcccggaaactttcttaaggatcaaagattagcgtccctggaaaggtaacgaattataaaaaggcgcgaataacttagcaatgtattcttatttcattttttgaataagcatgtggcgaaaacagatttttatttatatatatttatctgcaaaattttaaataaagctccaataaatcatattgttaatttcttcactttccgctgattcggtgccagactgaaatcagcctataggaggaaatgatggtacgtatctatacgttgacacttgcgccctctctcgatagcgcaacaattaccccgcaaatttatcccgaaggaaaactgcgctgtaccgcaccggtgttcgaacccgggggcggcggcatcaacgtcgcccgcgccattgcccatcttggaggcagtgccacagcgatcttcccggcgggtggcgcgaccggcgaacacctggtttcactgttggcggatgaaaatgtccccgtcgctactgtagaagccaaagactggacccggcagaatttacacgtacatgtggaagcaagcggtgagcagtatcgttttgttatgccaggcgcggcattaaatgaagatgagtttcgccagcttgaagagcaagttctggaaattgaatccggggccatcctggtcataagcggaagcctgccgccaggtgtgaagctggaaaaattaacccaactgatttccgctgcgcaaaaacaagggatccgctgcatcgtcgacagttctggcgaagcgttaagtgcagcactggcaattggtaacatcgagttggttaagcctaaccaaaaagaactcagtgcgctggtgaatcgcgaactcacccagccggacgatgtccgcaaagccgcgcaggaaatcgttaatagcggcaaggccaaacgggttgtcgtttccctgggtccacaaggagcgctgggtgttgatagtgaaaactgtattcaggtggtgccaccaccggtgaaaagccagagtaccgttggcgctggtgacagcatggtcggcgcgatgacactgaaactggcagaaaatgcctctcttgaagagatggttcgttttggcgtagctgcggggagtgcagccacactcaatcagggaacacgtctgtgctcccatgacgatacgcaaaaaatttacgcttacctttcccgctaacaaaaacattcccccagcattgggggaatcatcaccaacctgtcggcaacgcgtttctccgactatgctcaaaagtcatgtgataacaaaggggtgaactatggccagtggcgatcttgtccgttatgtcataaccgtcatgttgcatgaggatacattgactgaaattaacgagttgaataattacctgactcgcgacggttttttgctcactatgacggatgatgagggaaatatccatgagctgggaactaacacttttggacttatcagtacccaaagtgaagaagaaattagagaactggtttcggggcttacccaaagtgcaaccggcaaagatcctgaaatcaccatcacgacctgggaggaatggaatagcaacagaaaataaatggtttttgggcaataatcagtctgtggtgtgcgttagctcgtgtttttacaccgcattcttgcgctaaccttatgatctggcagacaacatgggagagacatcatgtggcaggcaatcagtcgtcttttgagcgagcagttaggtgaaggcgaaatcgaactgcgtaatgaactgcctggcggagaagtccatgccgcatggcatttgcgctatgcaggacatgattttttcgtcaaatgtgatgaaagggaactgcttcccggttttaccgccgaagccgaccaactggagttactgtcgcgtagtaaaaccgtcaccgtgcctaaggtttgggcagttggcgctgaccgtgactacagttttctggtgatggattatctcccacctcgtccgctggatgcgcatagcgcatttattcttggtcagcaaattgcgcgtttacatcaatggagcgaccaaccacaatttggccttgatttcgataacgcgctctccacaactccacagcccaacacctggcaacgtcgctggtcaacgttttttgctgaacaacggattggctggcagttggaactggctgcagaaaaagggatcgctttcggcaatatcgacgccatcgtcgagcatattcagcagcgtctggcctcacatcaaccgcagccttctctgttgcacggcgatttatggtccggcaactgtgcactgggtccggatggcccgtacattttcgacccggcctgctactggggtgaccgagagtgcgacctggcgatgttaccgctgcatactgaacagccgccacaaatctatgacggctatcagtcagtatccccgctacctgccgatttccttgaacgtcaaccggtttaccaactctacacgctgttaaatcgtgcaaggttatttggcggtcagcatttggttattgctcagcagtcattggatagattattagcagcatgatatgggttgaggataatggccgctccgtgcggccttttgattaaataaacccaagcagagaaaagaacacataacctgcagcaatacaaataaccggcaggatatacagtgagaaaaactgcaggaaaatagtatggtgcggaacaacaatacgggactcaatttgttcacgcgttagcccctcttcccctttggctttttccagaatgagttgatcttcaacaccttcccgcaagaagcgcgcctggcgactcatccgggcaccggaatcctgcaacgccagtccgacaaaaatcaggatgaaaatcacccagaacataacgttcacgccaccattaaaattgggcgtcggggagttataccagaatagattcaaaaaaggcgtattcgcctgcatcatatcgatcatgacatgagtaaagtcgagcatgaccgcattaatgccttccttgttttcctgccgggtattcataaatttcagcaaagaaatcaatgtagagatcaatgcaggtataaaaatcacccaacccaaaatccttttcaaaacagcaatgcgtccagcttgttgatacgtcatgagttctccttgattaagacgcgtcgtttcacttagtttacctgtagatatctgttttcgcccattctttaaaggcgatatgataggcgcttaatcataagcacggcttaataccttacacataatgctctaaaggagaggttgtaatgtcaaccccgcgtcagattcttgctgcaatttttgatatggatggattacttatcgactcagaacctttatgggatcgagccgaactggatgtgatggcaagcctgggggtggatatctcccgtcgtaacgagctgccggacaccttaggtttacgcatcgatatggtggtcgatctttggtacgcccggcaaccgtggaatgggccaagccgtcaggaagtagtagaacgggttattgcccgtgccatttcactggttgaagagacacgtccattattaccaggcgtgcgcgaagccgttgcgttatgcaaagaacaaggtttattggtgggactggcctccgcgtcaccactacatatgctggaaaaagtgttgaccatgtttgacttacgcgacagtttcgatgccctcgcctcggccgaaaaactgccttacagcaagccgcatccgcaagtatatctcgactgcgcagcaaaactgggcgttgaccctctgacctgcgtagcgctggaagattcggtaaatggcatgatcgcctctaaagcagcccgcatgcgttccatcgtcgttcctgcgccagaagcgcaaaatgatccacgttttgtattagcagacgtcaaactttcatcgctgacagaactcaccgcaaaagaccttctcggttaatgaccaggggcagtgatctcgctgcccctggttctttatctgaaattgcattcaactgacggattaatcgtcaatttaagagaaagagttacaccgtcaccacttccgtgcactgtataaaaatcctatactgtacgtatcgacagtttagtgagttttatcatgacggcggaaggtcaccttctcttttctattgcttgtgcggtatttgccaaaaatgccgagctgacgcccgtgctggcacagggtgactggtggcatattgtcccttccgcaatcctgacgtgtttgttaccggacatcgatcacccaaagtcgtttcttgggcagcgattaaaatggatatcaaaaccgatcgcccgcgcttttgggcatcgtggttttacccacagtctgctggcggtatttgcgctgctggcaaccttttaccttaaggttccggaaggctggttcattccggctgatgcgctacaaggaatggtgctgggttatttgagccacatacttgccgatatgctgacacccgccggtgttcccctgctctggccatgccgctggcgtttccgcttgcctatcctggttccccaaaagggcaaccaactggaacgttttatctgcatggcattatttgtctggtcggtatggatgccccattcattacccgagaacagcgctgttcgttggtcatcgcaaatgatcaataccttgcagatccagtttcatcggcttattaagcatcaggttgaatactaaaaaggcaaaaatcacctttctggaataagcaattccatttgaatataagagccagctcacagttctgttaatcttgcgccaacactatgactgctacgcagtgatagaaataataagatcaggagaacggggatgaactttccattaattgcgaacatcgtggtgttcgttgtactgctgtttgcgctggctcagacccgccataaacagtggagtctggcgaaaaaagtgctggtgggtctggtgatgggtgtggtttttggccttgccctgcataccatttatggttctgacagccaggtacttaaagattctgtacagtggtttaacatcgttggtaacggctatgttcaactgctgcaaatgatcgttatgccgttagtcttcgcctctattctgagcgcggttgcccgtctgcataacgcatctcagttaggcaaaatcagttttctgaccatcggtacgcttttgtttaccacgctgattgcggcgctggtcggtgtgctggtcaccaacctgtttggtttgacggctgaaggtctggttcagggtggtgcagaaactgcacgtctgaacgccattgaaagtaactatgttggtaaagtctctgatctgagcgttccgcagctggtcttgtcctttatcccgaaaaacccgtttgccgatcttaccggagccaatccgacgtcaattatcagcgtggtaatttttgccgcattcctcggcgtagctgcattgaaactgctgaaggatgatgcgccgaaaggtgaacgcgtcttagccgctatcgataccctacaaagctgggtgatgaaactggttcgcctggtcatgcagttgaccccttacggcgttctggctctaatgaccaaagtggttgcaggttctaacttgcaagacatcatcaaactgggaagtttcgttgtcgcgtcctacctcggtctgctgattatgtttgcagtgcatggcattctgctgggcattaatggcgtgagtccgctgaagtacttccgtaaggtatggcctgtgctgacgtttgcctttaccagccgttccagtgctgcgtctatcccactgaatgtggaagcacaaacgcgtcgtctgggcgttcctgaatccatcgccagtttcgccgcctctttcggtgcaaccattggtcagaacggctgcgccggtttgtatccggcaatgctggcggtgatggttgcgcctacggttggcattaacccgctggacccgatgtggattgcgacgctggtcggtattgttaccgttagttccgcaggcgttgccggtgtcggtggtggtgcaactttcgccgcactgattgtactgcctgcgatgggcctgccagtaaccctggtggcgctgttaatctccgttgaaccgcttatcgacatgggccgtacggcgttaaacgttagtggctcgatgacagctggcacgctgaccagccagtggctgaagcaaaccgataaagccattctggatagcgaagacgacgccgaactggcacaccattaattcttatgctggcaacggtccgttttgtataggggccgttgccttactttttaaatgttccatcgcggcgatgcatactgactcatatttaaacagatcgtcagcgaaaaaaatgtccaacttatcaatacattcctggctcaatgaatgtgcctgtagcgagaagcttaaaacctcatacccgagacgttttctaagtgaactatctggaatactcataatatcttcaagcacaccacttcccattcccggaagatttagtggattaaaaagaagattgatattaagcattgatattatcgaaggaaactttaggagactctcatttttttgaatcgcagcaaaaatgctcccgacaggatgtatataattttgttcatagtatatagtccttaaatagtgaataaccaacctgttttttatactgatcaaattggtcattttttctgggcgaaatacagaagtgacatccattccaataaaatctttatttatacctcttatccgaatttcactaccataaagattattaattattactctatatttaacattgtcctgcagatatgtatcaaaactaagtgctggcgctcctggctttgaggcatcatagttaatgttagacatataggcaatcatataattaaagtttgattctgctatttcatcgcagtcacattgacccgttgatataaagaaagtgagtgctgtcatagtagactgcagcctttctttaaaagagtcgaaagccaggcttttaatatttaaatcaccataattactctgtattaagtttgtagaaaacatctcccgcctcatattgttaacaaaattattatctcatttaaatctaagtcatttacaatataagtttaagagcgacgccacaggatgaactatcaaaaatagctcatcatgattagcaaaacttaaccattttaaaataaataaacaattaaagaaaaaagatcacttatttatagcaatagatcgtcaaaggcagctttttgttacaggtggtttgaatgaatgtagcaacgaaatacagaatttcaggtcatgtaactcccggcaaaaccgggaggtatgtaatccttactcagtcacttccccttcctggcggatctgatttgcccaacgttgggcagattcaggcacagtaaacgccggtgagcgcagaaatgactctcccatcagtacaaacgcaacatatttgccacgcagcatccagacatcacgaaacgaatccatctttatcgcatgttctggcggcgcgggttccgtgcgtgggacatagctaataatctggcggttttgctggcggagcggtttcttcattactggcttcactaaacgcatattaaaaatcagaaaaactgtagtttagccgatttagcccctgtacgtcccgctttgcgtgtatttcataacaccgtttccagaatagtctccgaagcgggatctggctggtggtctatagttagagagttttttgaccaaaacagcggccctttcagtaataaattaaggagacgagttcaatgtcgcaacataacgaaaagaacccacatcagcaccagtcaccactacacgattccagcgaagcgaaaccggggatggactcactggcacctgaggacggctctcatcgtccagcggctgaaccaacaccgccaggtgcacaacctaccgccccagggagcctgaaagcccctgatacgcgtaacgaaaaacttaattctctggaagacgtacgcaaaggcagtgaaaattatgcgctgaccactaatcagggcgtgcgcatcgccgacgatcaaaactcactgcgtgccggtagccgtggtccaacgctgctggaagattttattctgcgcgagaaaatcacccactttgaccatgagcgcattccggaacgtattgttcatgcacgcggatcagccgctcacggttatttccagccatataaaagcttaagcgatattaccaaagcggatttcctctcagatccgaacaaaatcaccccagtatttgtacgtttctctaccgttcagggtggtgctggctctgctgataccgtgcgtgatatccgtggctttgccaccaagttctataccgaagagggtatttttgacctcgttggcaataacacgccaatcttctttatccaggatgcgcataaattccccgattttgttcatgcggtaaaaccagaaccgcactgggcaattccacaagggcaaagtgcccacgatactttctgggattatgtttctctgcaacctgaaactctgcacaacgtgatgtgggcgatgtcggatcgcggcatcccccgcagttaccgcaccatggaaggcttcggtattcacaccttccgcctgattaatgccgaagggaaggcaacgtttgtacgtttccactggaaaccactggcaggtaaagcctcactcgtttgggatgaagcacaaaaactcaccggacgtgacccggacttccaccgccgcgagttgtgggaagccattgaagcaggcgattttccggaatacgaactgggcttccagttgattcctgaagaagatgaattcaagttcgacttcgatcttctcgatccaaccaaacttatcccggaagaactggtgcccgttcagcgtgtcggcaaaatggtgctcaatcgcaacccggataacttctttgctgaaaacgaacaggcggctttccatcctgggcatatcgtgccgggactggacttcaccaacgatccgctgttgcagggacgtttgttctcctataccgatacacaaatcagtcgtcttggtgggccgaatttccatgagattccgattaaccgtccgacctgcccttaccataatttccagcgtgacggcatgcatcgcatggggatcgacactaacccggcgaattacgaaccgaactcgattaacgataactggccgcgcgaaacaccgccggggccgaaacgcggcggttttgaatcataccaggagcgcgtggaaggcaataaagttcgcgagcgcagcccatcgtttggcgaatattattcccatccgcgtctgttctggctaagtcagacgccatttgagcagcgccatattgtcgatggtttcagttttgagttaagcaaagtcgttcgtccgtatattcgtgagcgcgttgttgaccagctggcgcatattgatctcactctggcccaggcggtggcgaaaaatctcggtatcgaactgactgacgaccagctgaatatcaccccacctccggacgtcaacggtctgaaaaaggatccatccttaagtttgtacgccattcctgacggtgatgtgaaaggtcgcgtggtagcgattttacttaatgatgaagtgagatcggcagaccttctggccattctcaaggcgctgaaggccaaaggcgttcatgccaaactgctctactcccgaatgggtgaagtgactgcggatgacggtacggtgttgcctatagccgctacctttgccggtgcaccttcgctgacggtcgatgcggtcattgtcccttgcggcaatatcgcggatatcgctgacaacggcgatgccaactactacctgatggaagcctacaaacaccttaaaccgattgcgctggcgggtgacgcgcgcaagtttaaagcaacaatcaagatcgctgaccagggtgaagaagggattgtggaagctgacagcgctgacggtagttttatggatgaactgctaacgctgatggcagcacaccgcgtgtggtcacgcattcctaagattgacaaaattcctgcctgatgggaggcggcgcaattgcgccgcctcaaatgatttacatagtgcgctttgtttatgccggatgcggcgtgaacgccttatccggcctacaaaactgtgcaaattcaatatattgcaggaaacacgtaggcctgataagcgaagcgcatcaggcagttttgcgtttgtcagcagtctcaagcggcgcagttacgccgcctttgtaggaattaatcgccggatgcaaggttcacgccgcatctggcaaacatcctcacttacacatcccgataactccccaaccgataaccacgctgagcgatagcacctttcaacgacgctgatgtcaacacatccagctccgttaagcgtgggaaacagtaagcactctgacggatagtattatcgataaacgccggatgacacatcacctccagcgaacgatcaccccgatggcctgcgtcatccagcacttgcaggaacagcgactcactgatctcttcaccgtagaatgcactgctgaatccctgggtagtgcgcaggttgaccggcaaatcaaacgccatctgacgatccgcccgcaacgcaatgccctgctctgccgcaaacctggcaacaatcgggaaaatctgcgggaacatatgcacatgatgatggctatcaagatgcgtaggtttgcgtccaaatagctcaatgaaacgcaaatactgactgacaagctcctgagtaatttcttccagcggtaaagcatcttcttctgccaactgccagatccattttcccagcacaccatcgcgggttaaccccggcatagctgtcagtggcttacccatagtaaggacaaagtgcatccctatggccagactcggttcatcacgactcaactgcaccgcatggtcaatagcctgcccattcaccagcgccgtcgtcgacgtgacaatcccattgcgacaggcctcgataatgccgtagttctgacctttgcttaagccaaaatcatcggcattaacaatcagtaagcgttccataatcagcctcggttaatgtgcttttttaagctctgcgatgcagtcggcaaagtttggcagccatttctcgtgcgccagaatcatctcgcgtgccagcagctcagcatcgcgatcggaatgcaccaacggactaaggtttagcgccagtaacacatcgttaaattctccgctaagtgcggcgttactggcagcaatctcgaagcctttaatggtgtgaatcagccccattactttatcatcgaaatgcgtaatgcgcggatgtggcgtcgcgccatcgcgccccagcttacaggtcatttctactgcccagtctgccggaatattatcaatctgcccatgatgcgggatattaacgtaatgttctgcttgcttgtcgttgtagatagcgttgatcacttcgcatgctgcatcagagtaataagccccaccgcgctgttccagttctttcggcttaactttcagctcaggatttttatacagctcaaaaagttgtttctcgactttctgtactacctgcgctcgtgcgccgcctttgtagtattcgcccatttcaatagccagcatctctttctgcttgaagtaatacagcagataagaacatggcagcagattcaacgaacgaattaagccctcactaaatggcagatcgaaaatattttttacagaggacgcttttaactgccctgacgccacaccatcaagcaattcggcaaagcgcgacttgccatttatcagcacatccttaatgaacaccatatggttgaggccgaacaaatcgatagataaatcatcgctgtctttcagcatcagaacatcgcgaataaacatcttcatgccgatcggaatattacacacgccgataaagcgtttaaatccggtatgacgataaacggcttcagtgaccattcccgccgggttagtgaagttaatcacccatgcattcggacaaagttcttcgacatcttttacgatgtcaaaaatcaccggaatggtacgcagacctttaaacaaaccgcccgcgccgttggtttcctgaccaagataaccatgacttaatggaatacgttcatccagttcacgcgccggtaattggccaacgcgcagttgggtagtaacgaaatcagcatctttcaatgcttcgcggcgatccagcgttttataaagcttcatcgggacgccagcgttatcaatcatccgttggcagagatcgaaaataatatccagtttcggtttaccaccttcgacatccaccagccataattcgctgaccggcaattcgtgataacgcttaataaatccttccagtaactccggggtatagctgctcccgccaccaatagtgacgacttttaatttctggctcataatttctcccttcagtacagaatactgatatctggcatatctgcccccccggacataaataatccagcaacaggacagatatgtgaattgtcaggtataacgacttactgattaaattcagtcaatttcttacgatagctcttaggcgtaaaggacgttaatttcttaaacgttttaataaacaaactcgggctactataaccggcctcaaacgcaatatccgtcactgaatagttggtcatttccagttgttttttggcaaaattaatacggatttcattaataatctgcattggcgttttgccataatatcgttgagtcgctcgcgtcaaatattcctgtgatttggctgacaacgccaccatattctccagcgccgattcactaaactgctctttatcatgcatcttttctaccgtacttttcagccactgcggtacatcatcaatcacctgttcttcgcggtaatgacgtaaacggttaatgacataaaaagtaaccatctcaacaaactcttccagccctgtttcgcggaaattcaatgaagaaatcactgtttccacataggtgagaaaagcgttattggtccggtatacctgcgaagcgacaaagcaataaggcaacaatggcaggtaatgctgctcaaaaaagcgtttactgatcccaacgttcaatatgcgcgtggcaccaaactcataaaaactttgatggtgcgaacctaacggaataaaaacaaaatcgccccgttccagtaacacgcgcttaccgttaatctcctggaaataacgcccggttaataccagagtaaattcataatagtcgtgctgatgcagtccgctgatactctcagttttgttatagataaacacatggaagtttttgccattaaacaactgctgttctcgggcagtggcaatttccggcgcgttaatcactggctgcatcatcgactccttatgccttcagtttttcatgaagctcaattaattcagtaatcagttcacgcgcaagcatggacgtcattaaatgatcctgagcgtggaccagcaccagactcactttcatcttaccttcgcccgcatcgccttcaatcagtttcgtctgtaccagatgcgcttcattcaatgccatccgtgactgatccatcatggcttttgctgcggcaaaatcgccctgcttcgcctgtttcagtgccgcatacgccaggctgcgcgcttgtccggagttgatgatcagccccatcaccacttcttccagctcttcagcttccgtttgcgtatcgggaatgttatcgagatccatcatacatcgttcctctcttttcttaccggcacgattacccgtaccggcatcgattaaaatttcagggcgttagcgatatcttcttcgctctcttctttatcaatcgcattttgtgctttgttagccaccacaacaaagggcagataaattaacgttgcgatgccaaggttgaagagtgcgaccagcaatgcggcgacgctaccgttggtgttaaagaaggctcccagaccggttggcatggtccacggtgcaatattggtcaccggaggaataatgcccatgtagtacgctgcgagggtgattgccgccagaatcggttgtaccagtacaaacgggataaacatcaccgggttcatgataattggcagaccaaacagaatcggttcgttaatctggaagatgccggacggcagcgccagttttgccacctgacgataatcagcacggcgagaggcgataaagatagccaggatcaggcctaaagtcgcaccactgcccccaaggaaaataaaggagtccagcatcggcttggcccagatatggaaggtcttaccggctgccagcgccgcttcgacggaaccatattgctgataggtcgcgatattttccagtgcccacggcgtcataatgccgttgtccagtgcggtcagcgccagcgcgccatgaataccgaagaaccagagcagtggaacaaagatcacataggcccagcccaccacgctacccaacgatgccagtggggttgagatggtatccataatgatctgatggaagttggtgccccaggtattcaacgcccaggcaataatccccatcacggaaagaataataaagccgggaattaatgccgagaaggaacgcgatactgaagcaggtacgctgtcgggcagtttaatgacccaattgcggcggacaataaaggtaaacatttctgccaccaccaggccaataataatcccggagatgatattcgccccacctaaccagtttgcaccaaccgcataggcctcaccgacactatatggggtgacggtcataaatgctgcaacggataacaacccagccgccagcgcatcgactttacgctcttctgccagcgccatgccaataaagaacggtgccattaaagacattattcctaatgttccgttatatacgttgccgccaatacctttcagaccattaagtgtttcaatggttgaggcgtcgaggcgaatacctaaggaataaaaaaacgacccctccccaaagcttagaaaaacgttgttaattaatacaaacatggcccccgcaagggttaacggcattaagcgaataaagccatttttgattgcattaacgtgtggctgctttcctattttaactgcaaaagggaggagtaccttttcaagcgatgcaataacattactcatagaaaaatacccttaaaaaccgcaatttaaatattgcggtattgatttatgaaataactctttgacgggaaaatttaaaataaattaatttgctgcggcttttttaatcgctgcaaccgcagccttaagcacgcctaaaccatcgactttgccataaagcagcgagtcaattacttcaaccggtttgttgggtaacaaacgctggatttcgggcaacatataagcaatctgcggccctaataacacgacatcggcattctgacctttttcaccagccagtgtttccggaaatgcttcaataatgaccggaacttcatatttttctgcctgtgcgcgcatttttgataccagtaaagaggtagacatgcccgcagaacaaaacagataaatgtgtttcttttccataaaactgccctcatcgacgattatctgtcagccagacactccgcaagccttaacctgcttccatgctctgggtaacttgcgaaaccaacatgactttttttgtggctgaaaggagtatacggtatagacctgagcaatagtatttctttgaccttataaattgtttctccttgacctgtggttatgaccctcttcacatttcgggcaaataattcgcgaagataattaagaactcaggccaaaaaaaaccggcgcaatggccggtttccgttgttactcaagctttcagacgaattgattacttcgcagcctgtggatcagtgtcgtattcagcacaggtctgataaccggagttgatgacatgtccggtatcatctaacgcgacaaagtaggtttctgctttaccatcacgttgacccaggatgtaggtctggcaagtaccgcgagcatggatcatgctcacttcagacgaaggtttacccgcaatttgtgcaacctgcgcccggctcatgccttttttgacgtctttcaccacaggctgtacaaactggtctttggtacgatcataagccgtacaacccgccagcatggttaataccgccgctgcactcagaattcctgccatattcttgttcatattccgtcctcttgtttatcagcgtgttagataagcctggaatacattgggcgctttttcaagcccgtgaacgaaacggctccgctttcagaggattcctgtatgacgttttaaccaccattcagcccgctgtcgcttgtcgtttcagtagcaacgggttagctttaaggaagttttgtcttttctgtctggaggggttcaatgacattgcaacaacaaataataaaggcgctgggcgcaaaaccgcagattaatgctgaagaggaaattcgtcgtagtgtcgattttctgaaaagctacctgcaaacttatccgttcattaaatcactggtgctcgggatcagcggcggtcaggactccacgcttgccggaaagctgtgccagatggcgattaatgagctgcgcctggaaaccggcaacgaatcactgcaatttattgccgtacgcctgccctatggtgttcaggccgacgaacaagattgccaggatgccattgcctttattcaaccggatcgcgtattaaccgttaatatcaagggcgcggtattggccagcgaacaggcattgcgggaagcaggcattgaactgagcgattttgtccgtggcaatgaaaaagcgcgtgagcggatgaaagcacaatatagcattgcgggtatgaccagcggtgtcgtggtgggcaccgatcatgcagcagaagccattaccggattcttcactaaatatggtgacggcggtacggacattaatccgctgtatcgtctcaacaaacgtcagggtaaacagttactggcggcattagcttgcccggaacacctttataagaaagcgccaacggccgatctggaagatgatcgcccttctctgccagatgaagtggcactcggcgtgacctatgacaatatcgacgactatctggaagggaaaaacgtacctcaacaggtcgccagaacaatagagaactggtatctgaaaaccgaacataaacgccgtccgccaattaccgttttcgatgatttctggaaaaagtaataatttgcacatattggattgtgcgaaaaagagtaatttgttcacgccggatgcggcgtgaacgccttattcgacctataaaactatgcaaattcaatacattgcaggagtcgaataggcctgacaggcgtagcacgtcagacggtgtaacctttgtcatcgacccgcctcttttttaatcgcttcccgcctgttacactggatagataaccagcattcggagtcaacagtggtacggcgtttaacttctccgcggctcgaatttgaagctgcggcaatttatgaatatcccgaacatttacgttcattccttaatgacttacccacccgaccaggggtgtatctgtttcatggtgaaagtgacaccatgccgctctatatcggcaaaagcgttaacatccgcagccgcgtcctttctcatttacgtaccccggatgaagccgccatgctacggcaatcccgacggatcagctggatatgtaccgccggtgaaatcggcgctctgctccttgaagcgcgattaatcaaagaacaacagccgctgtttaataaacggttgcgccgcaatcgccagctctgtgccctgcaattaaatgaaaagcgcgtcgatgtggtgtatgccaaagaggtggatttttcacgagcccccaacctgtttggcctgtttgccaataggcgcgcagctttgcaagcattgcagaccatcgctgatgaacaaaaactttgttatggcctgctgggactggaaccgttaagtcgcggtcgtgcatgttttcgttcagcgctaaaacgttgcgccggagcatgctgcggtaaagagagccatgaggaacatgcgctacgcttgcgccagtctctggagcgtttgcgggtggtgtgttggccttggcaaggggcggtggcgctgaaagaacagcacccggaaatgactcaatatcatattattcaaaactggctgtggctgggggcggttaattcgctggaagaagcgacaacgttaattcggacacccgccgggtttgatcacgacggttataaaattctttgtaagccgctgctttccggtaactatgaaattactgaacttgatccggcgaatgaccagcgagccagttgatttcactgaacaacagtttaccttgcggttgtaaaagccgcagggtgtgcctgccatcgaaccagcacgcgccctggtcggtagtgagcaatttatcgcccagttgccacgccccgttaatcacaaacaccaccccgccgcgtgagccaaaggtagtaaacgtacgttcggcaattctgactttcgccttacagacatccaggcgtgtcatgatgttgaaatccatcgacatctgccctgccgtcagtttcgcttttaccacctggtccgctgcaaaggcaaaaggctggaacggttttaaggtatggttaaagcggtctgcgctttcaaggagcatctcgccgccttccagcaacgtcactatcctttccatgccgggaaacaaagaaaactccccattcgccgcgatggatgcaatgctggcacgccagtaaaaatcacgttttgccggtgggaacgtgcaaatttcgcgcgtttcaccggcagcatttcgccacagattcaccgacattttacgcatatcaaagtattccatactcgctcccggcccgttcttttcattgttatcgttcaggtaaccgtggatggttatcggcaactcgggtgatttacgttagtggtgatcaggctttttttacaactgtttgagaagagaaaagaaaaccgccgatcctgtccaccgcattactgcaaggtagtggacaagaccggcggtcttaagttttttggctgaaagattattcagcagttgcaggcattttaccttttgccgctggacgttctgtcagacgcttctcaaaattagcattaaattgctttttctgttccggcgtcaggatgttgtaaattttgttctgggtttccatgtgcgccagcatgttagctttgcgctgttcttccatttttgcgatctgcgcttcagcttttactttatcgaaggtatcgctggcaatgatgtcatgcattgcgcggcgttcttccagcggcggacgtttcatctggtcacgctggcctttcatgatttcgcggatctgctgtttctgcgcgtcggtcaggttcaggtctttgaacatcatgtcctgatgcggaccgaacttgcctttgtggtgcatcatcggcttcgcgtcagccggtgctgcggtagtggtgtctgcggcatgggccaggttagccgcgccaagagccagggtagaggcaacaaacagtgcagttaatttacgcatattctatatccttcctttcagttatttattacggctttcttaagtagcgtgccgtgttgacgagattaactttactgactttagcgtcaattaatcagagcaacggtaaaacaatgaaagtgtaaaaaacacttttgcgccaattatggagaaaaaaagaaaatttgatggagagtgatgagagaatattacaacacgatgattttgcagagattatgaagaactataccggatgactggtgataaataaagcaaataaccaggattaatctgtattaatttataagaaagcaacttaatacccgcagaatgatttctgcgggtaagtattagcttattttttcgagcattaatcccgcgcgtaatcccaacgctaccaacggattagggaataacacatactctacatcatgggttacggtaaaacgttcctctccgtcctgcgccagcaatgttcctttctcaaacggcataaaattcagcgtgtcacttgccatatgcatttcgaaggacggcgagtggcgagtaatttgcgaaaccacccgataacggagcggcggtgttctcacgataccgacactctcaccagatagcagcgcagcaattgcgctggcagttactgcaaactggcgaagatcgttttgcccaaagggcaacgctttgccaagttccagcgtacaggccagcgcgccaaaatgtctggcgctgaaatgggtaaacgtaccaccaggttcctgatggaacaccagcgcctccagccccgccgcacccagccacgtcagaaatttctcgtcccagggaatgtcgcgttgcggtaatacaccgaactgcggatgcaaggagccacgaattgcggtatgtagatcaaggtgccagcgcacagattctttgccctggtcataaaaatcttccaggcactgttccagttcgcgcgcccgacaggtttctccgctttcagcaaatagctgccaacgaccgccaaacattcgattcatatcgctatggcaataacgtttcccttgcttcagcgcaggaggattcccgaggatcaccagcaaccgccaacgtaacgggatctcgccgtgagatatcgcgccaagcaacgcgtccagcatctccacaggtgccgtctcattaccgtgtattcccgctgaaatcaccagtgcgccttgcggtggcgttaatggcgtcagttccagcacaccatcgcccagccagcgccagcgaacgccgttgatttctcgctcggtgataaccggttttttacccgttaaggtcagagcaagaaaattatccattgccccctccctcgcgctggaacggataaaccgaaccgagattcagtaattggctcaatacatccagtgcttcccgcccttcgcgcagcaattgcgggtcggccagatcggcagcagtaaggcgatcgcggtagtaacgatccacccagtcattgagcgcattaaacagcgtatcgttcatcatcaccgccggattcaccgcccggcgttcttcttctgtcaataccacccgcaaccgcaggcacgccgggccgccgccattcgccatgctttcacgtaaatcaaagacttttagttcgctaatcgggttgtcagcggcaaggagttcattgagataaccccatactccggcgtgttcccgacactcctgaggcagcaccaacatcatggaaccatcatcgcggctcagcagttggctgttaaacagataggtagacaccgtatcagacacggaaacctgagttgccggaacttctatcgccataaaaccattgacccgcgcacgcaggtttgccagtaactgtgactggcgagcgaacgcctgttggtggcaaaacagcacctggcggttactcacggcaatcacgtcattatgaaaaacgccctggtcgataacgtccgggttttgctgggcgaaaatcacctgttggggattcacctgattcagccttgccaccgcctcgctggcttcgcgagtctgtcgcgccggataacgggaaggccgggtatcattgccttcttctcgcccgtagacaaaaagttgcatacccggttcaccgtaatgaccgccgagacgattgtggtttgccgccccctcatcaccgagcaacgctacctgtggcaacgccgaatggacgctaaatttctcttcgtcgttaaaaatcgcttttaacagcgattcagtgacgggcgcttccagcgaacggtgaaatttattgttcaggttggcaacggtgagatgcactttgccatccagcgtatcggcagatggcgcgatcgttgccgcattggctacccacattggcgaagcggaactgacgctggaaagccagtgcggtgcctggcgtgcaactttttccagtacctgctcatcgctaccactgaatcccaactgacgcagcaccggaataaacggacgctcgtgcggcgggatcacggcctgggggaatcccgcatcggcaagggctttcattttcagtaagccctgcttcgccgccagtcgcgggttagacacctgaaaacggtgacgggtagaggcttcattaccaaacgacaggcccgcgtaatgatgcgtcagccctaccagcccgtcgaaattgacttcccaggcgttcatcgcaccacctcatcggaaaaatccagcccggggttaagcgtggcgggcaatgttaacgagtccgactccaggctcgccatcggccatgcgcagtaatctgcggcataccaggcgctggggcgatggttaccggaagcaccaatgccgccgaatggcgcggtactggcagcaccggtaagcggtttgttccagttaacaatccccgcccgcgcctccagcaacagttgatcgaacttttcccgctcgggggaaaccagaccgcaagagagtccgaagcgagtgttattcgccattcgaatcgcttcatcgaaagtatcataacgccagacgcgcaataacggtccgaacacctcttcatctggtacgccagcaacgcctgtcatttcaatgatccccggcgtcagcaacgatgtccctgcttgtaataagcgcggcgcaagcaggggtcgtccgcccatcgcttccagttgctgccatgcagtaaccacctgctgtgcggcctgttcagaaatcagcccgccaataaacggctgcggttcgtcatcccagttgcccggcgttaatcgctggctgacggcaaccagacgagcaagaaacgcatcgccctgcgccccgcttttcagcaataaacggcgggcgcaggtgcagcgttgaccggctgtgacaaacgccgactgaatggtcagatggacagccgcgtcgatatccgccacctcatcgataattagcggattattaccgcccatctcaagggcgagaattttctccggctgaccggagagctggcgatgcaactggtagcctgtattggcgctaccggtaaacagcaaaccgtcgagatcctccagcgcactcagcgcctgacccgtttcacgcccgccctgcaccaggttcagcacgcctggcggcaagccagcctgctgccataaacgcattaccgcttcgccactccacggtgtcagttcgctgggtttaaagataatggtgttacctgccagcaatgccggaacgatatgtccgttcggcaaatgaccagggaaattatacggcccaaacaccgccagcacgccgtgcgggcgatgtcgcaggctcgccgcgccgtccggcatttcactacgctgctcgccggtacgaacgtgatacgccttaattgatatcgcgattttattgatcatcgccgtcacttcggttgccgcttcccagcgcggcttacccgtttctctggcaataatcgcggttaattcggctttattgctttccagcagtgcggcaaagcgttcgacaacggcatgacgttcagcaaatgaaagccgcgcccagcgcggaaacgccgcacgggctgcccgacaagcctgctcgacctgagcggcatcggcatcattgccttgccataacacctcgcccgataccggattacgcttcacacgcgatgcgccctggcccgttatccagtcaccgttaatccataaagtcatgctgttttctcctctgcgcacaggcgcaccagacgaacgcgatccccggcgtggcatttgagggcatccagttgtgcggcggttaaaatcaaacgctcggttgccggatcggtacgcaccagcaccacgcggaaatggtgataattttcattggcgaccaggcaggctgggaaatcgccctgcgcaggctgcccttctgccacttccaccagccgacttttacggatggcgcgcacgcggtcgatgtcacactcaagcgtcggcccaccgtcaaagatgtcgatatagttacggtagcgaaaaccttctttctccagcaccgcgcgggcaggcgcggtttgcggatgtacctgaccgatgacgtcctgggcttcctgggataaaaagtgggtatagatcggatgtttcggcatcagttctgcaataaatgccttttgcccggtgccgcagagaaaatcggcgcggctaaaatccatcgaaaagaagcgtttaccgaggctttgccagaacggtgaatagccgtgttcgtcaatcaccccgcgcatttcagcaaccactttgtcattaaacttgtcgcgaaaagccgccataaacataaagcgcgatttcgacagcaaatagccgttgccctctttgcgccagtccgggtcgagaaacagcgtgcacagctcgctgctgccggtgtgatcgttactgagaaacagcgtcggcaatgcgttatagacattcagctcttttgaggcgtgaaccaacgtgccgacgcgatagttgtaccagggatcgttcagcccaaccgccacctcaatggcacaaatccccgccacggtgcctgtctcgctatcttccagcacgaacacatagccctgctcacttttgggcagttcgccttgccaggttttgattgccctttcgatacgcgccgaaagcgtggcttcattggcgggaagcgacgtcaggccgccgcccgttttgctggcaagctgcatcagcgccgagacatctgatcgctcaacgggacggatgaccatcatgatgaacctcggctaacaaagtgttcgcaagcagctgcaaagcgatccagtccggtcgtcacctcttcttcgctgacattgagcgcaggcgcaaaacgcaccacgttgccacccgcaatcagtaccatcacgcctgctttcgccgcttcctgagagatctgtttcgcttgcccggcgtaatcggcattcagtacacagccaatcagcaaacctaagccgcgaacttcactgaacaaaccatagcggtgattaatagtattaagacgctcaacaaaccagtcgtgacgctgtttaacgccattaagcatctctggtgtgttgatgagctccagcactttgcctgccaccgccgaggccagcggattaccgccataggtggtgccatgagtgccaacggtcatcacgcgggcgcactcttcggttgccaacaacgcaccgaccgggaaaccgccgcccagcgctttggcggtagttaacagatcaggcgtcacgccgtagtgcatataggcatacagttccccggtgcgcccgacgccggtttgtacttcatcaaaaatcaacagcgcattgtggcggttacacaattcacgcagaccttgtaaaaacgcgttgctggctggcaccacaccgccttccccctggatgggttcgacaatcaccgcacaggtagagtcgtcaatcagcgcgctggcagagttaatatcgttatatgcagcatgacgaatatccgccggcagtggcgcaaaatcctgtgaataggctggctgcccacccgcactgacagtaaacagcgtgcgaccatgaaacgcatttttgaacgccacgatgccgctcttatggctgccgtagcggtcgtgagcgaatttacgcgccagttttagcgccgcttcgttggcttccgcaccggagttacaaaagaagacgcgatcggcaaacgtggcgtcgatcaattttttcgccagtcgcagtaccggctcgttggtgtaaccgttgccggtatgccagaacttactcgcctgttcgttcagcgcttcacgcagttccggatgcgcatggcccagcgcgttcaccgcaatgccacccgcgaagtcgatatactctttcccctgctgatcccacaagcgcgaaccttcgccacgtaccggtataaagggtgccggagcgtaaacaggtatcatccattcatcaaagttttcacgcgtaattggctgagacatagcgacctctacagtaaataattcgttatttatatgttaataataagtaatgtttgcgctgtaaatgtagattgcagggttcgtgccagccagtgataaaagtgcataaacggcggaggctaactggaaatcaaggagttataaccaaaccatatgcatttaaagtgcatataaagtgaatacgtttgcgatgtgggtgaataaaaagaataaaaaacgcaatgttatgcagaagtaaaatataattctggaattgtgatcattgacgaaatttactggaaattactgcgccattctgacgcagcgcgcaccaaaagcgggcattttttgcgccatcgttgacatcattaacaaccatcgatcaaatcacttaacaacaggcggtaagcaacgcgaaattctgctaccatccacgcactctttatctgaataaatggcagcgactatgaaatttgtctcttttaatatcaacggcctgcgcgccagacctcaccagcttgaagccatcgtcgaaaagcaccaaccggatgtgattggcctgcaggagacaaaagttcatgacgatatgtttccgctcgaagaggtggcgaagctcggctacaacgtgttttatcacgggcagaaaggccattatggcgtggcgctgctgaccaaagagacgccgattgccgtgcgtcgcggctttcccggtgacgacgaagaggcgcagcggcggattattatggcggaaatcccctcactgctgggtaatgtcaccgtgatcaacggttacttcccgcagggtgaaagccgcgaccatccgataaaattcccggcaaaagcgcagttttatcagaatctgcaaaactacctggaaaccgaactcaaacgtgataatccggtactgattatgggcgatatgaatatcagccctacagatctggatatcggcattggcgaagaaaaccgtaagcgctggctgcgtaccggtaaatgctctttcctgccggaagagcgcgaatggatggacaggctgatgagctgggggttggtcgataccttccgccatgcgaatccgcaaacagcagatcgtttctcatggtttgattaccgctcaaaaggttttgacgataaccgtggtctgcgcatcgacctgctgctcgccagccaaccgctggcagaatgttgcgtagaaaccggcatcgactatgaaatccgcagcatggaaaaaccgtccgatcacgcccccgtctgggcgaccttccgccgctaatttagcagctctcctggctcaaactgggtcaggagaattaaccttgagaaaaatcaacaaactgtcagtaatgatttgttgcctgccgtcctttgttataccgtctctgcgtttttagttgtctgaccacttctctattatcaagtttgatataggaaactccacgatgaacgctgagcgtaaatttctttttgcctgtcttatttttgcgctggtcatttacgctatccacgctttcggtttattcgatctgctcaccgatttaccccacttacagacactcatccgccagagcggatttttcggctatagcctctatattctgttattcatcattgccaccctcttgctgttaccaggaagcatactggtgatcgcgggaggaatagtttttggcccgctcttagggacactactctcattaattgccgccacgctggcctcctcgtgctcattcctgctggcgcgctggctgggacgtgatttactgctgaaatacgttggccatagcaataccttccaggccattgaaaaaggcattgcgcgtaacggtattgattttcttattctgacccgcttaatcccgttgtttccttacaatattcaaaattacgcttacggattaaccacaatcgccttctggccttatacccttatttcggcactcacgaccctacccggtattgttatttataccgtgatggcaagcgatctcgccaatgaaggcattacgctgcgctttattttacaactctgtctggcgggcctggcgctgtttattctcgtccagctcgcaaaactctacgcccgacacaaacatgtggatctgtctgcttcgcgccgcagcccacttactcacccaaaaaatgaaggatagaacgatgttgcaacattattcagtgtcatggaaaaaaggactggctgcactctgtttactggctgttgctgggcttagcggctgcgatcaacaagagaatgcggcggcaaaagtggaatacgacggactttcgaacagccaaccgctgcgtgtcgatgccaataaccatacggtaaccatgctggtgcaaattaatggtcgtttcctcaccgacgacactcgtcacggtattgtgtttaaagatggctccaacggacataaatcgctgtttatgggttatgcgaccccgaaagcattttatgaagccctgaaagaggcaggtggtacgccgggcgaaaacatgacgatggataataaagaaacgactcatgtcacaggcagcaaactggatatttcggtcaactggcaaggggcggcaaaagcgtattccttcgatgaagtgattgttgacagtaatggcaagaaactggacatgcgctttggcggtaatttaacggcagcagaagagaagaaaacgggttgcctggtgtgtctggatagctgcccggtcggcatcgtcagcaatgcaacatacacttatggtgcggttgaaaaacgtggtgaagttaaattcaaaggcaatgcctcagttctcccggcggataacacgctggcaacggttacctttaaaatcgccgaataaagccaggataaaggatgatgatgatgcaatcgcgaaaaatctggtactaccgtataaccctcatcatcctgttgttcgctatgctgctggcatgggcgctgcttcccggcgtccatgagtttatcaatcgcagcgttgcggcgtttgccgccgtggaccaacagggtatagaacgctttattcagtcttacggcgcactggcggcagttgtctcgttcttgttgatgattttgcaggccattgctgcaccgctacctgcgtttttgatcacctttgccaatgcgtcgctgtttggcgcgttctggggcggcttgctgtcgtggaccagttcgatggccggcgcggcgctgtgcttttttatcgccagagtgatgggccgcgaagtggtggaaaaattaaccggcaaaaccgtgcttgacagtatggacggctttttcactcgctacggcaaacacaccattctggtctgtcggttattgccttttgtccctttcgatccaatcagctatgctgccggtttgacttcaatacgttttcgctcgttttttatcgccaccgggcttggtcagttaccggcaactattgtttattcctgggcgggcagcatgttaacaggcggtactttctggtttgtcaccggactgtttattctgtttgccctgaccgtggtgatttttatggcgaagaaaatatggcttgaacgccagaagaggaatgcctgatgggtttaccgccgcttagcaaaattcctttaattttacgtccacaggcgtggctgcatcgtcgccattacggcgaggtgctaagccccattcgctggtgggggcggatcccgtttatcttttatctggtgtcgatgtttgttggctggctggagcgcaaacgctcaccgctcgatccggtagtacgatcgcttgtcagcgcgcgcattgcgcaaatgtgcctgtgtgagttttgtgtggatatcaccagtatgaaagtcgccgagcgcaccggcagcagcgataaactgctggcagtggctgactggcggcaaagcccgctctttagcgatgaagaacggctggcgctggagtacgccgaagccgcaagcgtaacgccgccaacggtcgatgatgccctgcgtacccgactggctgcgcattttgacgctcaggcgctcaccgaactgacggcattgatcggcctgcaaaatctgtcagcccgttttaattctgccatggacattcccgctcaggggctgtgccgtattcctgaaaaacgttcttaaggagagatgatgcgccattgtgggtggttgctgggattgttatcgctgttttctctggcaacacatgccagtgactggcaagaaattaaaaatgaggccaaagggcaaaccgtctggtttaacgcctggggcggcgataccgcaattaaccgctatctcgactgggtgagcggcgagatgaaaacccattacgctataaacctgaagattgtccgtctggcggatgccgcagacgcggtgaagcgcattcagaccgaagccgcagccggacgtaaaacgggcggctcggtggatctgctctgggtgaacggcgaaaacttccgcaccttaaaagaggccaatttattacaaacgggctgggcggagactctgcccaactggcgctatgtcgacacacagctgccggtgcgggaagatttttctgtgccgacacaaggtgcggaatcgccctggggcggcgcacaactgacgtttatcgcccgccgcgatgttacgccacagccaccacaaacgccgcaagccttactggagtttgctaaagccaatcccggcacggttacctatccgcgcccaccggactttaccggcacggcgtttcttgaacagttgctgattatgctgacgcccgatcccgccgcattaaaagaagcgccggacgatgcgactttcgcccgtgtcactgctcccttgtggcaatatcttgatgtgctgcatccgtatttgtggcgcgaaggaaaggatttcccgccttcacccgcgcggatggatgctctgctgaaagccggcacattgcgcctgtcgctgacctttaaccccgcgcatgcgcagcaaaaaatcgccagcggcgatttgcctgcaagcagttacagttttggctttcgcgaggggatgattggcaacgtgcatttcgtcaccattcctgccaacgcgaatgccagtgctgcggcgaaggtagttgccaatttcctgctctcacccgatgcgcaactgcgtaaagcagatcccgctgtctggggcgatccttctgttctcgatccgcaaaaactgcctgacgggcagcgcgaatcattgcaatcaagaatgccgcaggatctgccgccggtactggctgaaccgcacgcaggttgggtaaatgcgctggaacaagaatggctacaccgttacggtacgcattaatctttttgctgtgggcgatggtggcggtgatttatgcaccgctgatcccggcagctctcacgctgatatcgcctgctttgtcgttgacacactggcaggcgttatttgccgatccacagttaccgcaggcattactggcaacgctggtgtcgacaaccatcgcggcggtcggggcattgttgattgccctgctggtgattgtggcgctgtggcctgggccgaaatggcagcgtatgtgcgcccgtctgccgtggctgctcgccattccccatgtggcttttgccaccagcgcccttctgctctttgctgacggagggctgctttatgactatttcccgtatttcactccgccaatggaccgatttggcatcggtctgggcctcacccttgcagtgaaagaaagcgcatttctgctgtggatcttagcagcagtattgagcgaaaaatggctgttgcagcaggtcattgtgctggattcgctgggctacagccgctggcaatgcctgaactggctgctgttgccctccgtcgcgcctgcgctggcaatggcgatgctggcgattgttgcctggtcgctgtcggtcgtggatgtggcaattattctcgggccaggtaatcccccgacgctggcggtaattagctggcagtggttaacccagggcgacattgaccaacaaacaaaaggcgcgcttgccagcctgctgttgatgctgttactcgccgcctacgttttgctgagctatctgctatggcgcagctggcggcgcactattccccgcgtagatggcgttcgcaagcctgccacgcctttattgccgggcaatacgctggcgatttttttacccttaaccggtgtgctgtgtgtggttctgctggcgatcctcgcggatcagtcgacgatcaatagtgaagcgctcatcaacagcctgacaatggggctggtggcgacattcatcgctttgctcctgttactgctgtggctggaatgggggccacagcgtcgccagttgtggctatggttgcccattttattacctgctctgccactggtggcgggccagtacacgctggcgctatggctgaaactggatggaagctggacggcggtggtctgggggcatctgctgtgggtgatgccgtggatgctgtttatcctgcaacccgcctggcagcgcattgattcacggttaattttgattgcgcaaacactgggctggtcgcgggccaaaatcttcttttacgtgaaatgcccactcatgttgcgccctgtgctgattgccttcgcggtgggatttgcagtcggtattgcgcagtatatgccaacgctgtggctgggcgcggggcgttttccgacgctcaccactgaggcggtggcattaagcagcggcggcagcaacggtattctcgccgcccaggctttatggcaactgctattaccgcttattatttttgccctgaccgcgttagtcgcaaaatgggtaggttatgtcagacaaggactccgctaatgctctgcgtgaaaaatgtttcgctacgtttaccagaaagccgcttgctgacaaacgttaactttacggtggataaaggtgacattgtcacgttaatggggccgtctggctgtggaaaatccactctgttttcatggatgattggtgcactggccgaacagttttcttgtacaggtgagctatggctcaatgagcaacggattgacatcctacccaccgcacagcgtcagattggcattctttttcaggatgcactgttatttgaccagttcagtgtcgggcaaaatttactgctggcgctaccggcgacacttaaagggaatgcccgacgtaatgccgtgaatgatgcacttgagcgttcaggccttgagggagctttccatcaggatcctgccactttgtctggcggtcagcgagcgcgcgttgctctactacgcgcccttctcgcccaaccaaaagcgttactcctggatgagccattcagccgtcttgatgtggctctgcgcgataattttcgccagtgggtgttcagcgaagttcgcgccctggcgatccccgtcgttcaggtaacgcacgatctccaggatgttcctgctgatagttctgttctggatatggcgcagtggtcagaaaattacaacaaactgcgataacgcaaagtttttctcaatgcgtcagttcagaatggcgcactcaaaactacaatgtcgggattttcgatgaaacgtgtttctcaaatgaccgcgctggcaatggctttagggctggcttgcgcttcttcgtgggccgctgaactggcgaagcctcttacacttgaccagcttcaacaacaaaatggcaaagcgatagatactcgccccagcgcgttttataacggctggccacaaaccttaaatggcccttctggtcatgaacttgccgccttaaacctctctgccagctggcttgacaaaatgagcaccgaacagctcaacgcgtggatcaagcaacataacctgaaaaccgatgctccggtggcgctgtacggtaatgacaaagatgtcgacgccgtcaaaacgcgactgcaaaaagcaggtttaacgcatatctccatcctgagtgacgcgctaagcgaaccttcccgtctgcaaaaactgccgcattttgagcagctggtttatccgcaatggctgcacgacctgcaacaaggtaaagaggttacggcgaaacctgccggtgactggaaagtcattgaagcggcctggggcgctcctaagctttaccttatcagccatattcccggcgctgactacatcgataccaacgaagtggaaagtgaaccgctgtggaacaaagtttctgatgaacaactaaaagcgatgctggcaaaacacggcattcgccatgacaccacggtcattctgtatgggcgtgacgtatacgctgcagcgcgtgtggcgcagattatgctttatgctggcgtgaaagatgtgcgcctgctggatggcggctggcaaacctggtccgacgcgggactgcctgttgagcgcggaacgccaccgaaagtgaaagcggaaccggatttcggcgtgaagatcccggcacaaccgcagttgatgctcgatatggaacaggcccgtggactgctgcatcgccaggatgcatcgctggtgagcattcgttcgtggccagaatttatcggtacgaccagcggttacagctatattaaaccaaaaggtgaaatagccggcgcacgttggggacacgctggtagcgactcgacgcatatggaagattttcataacccggatggcaccatgcgcagcgccgatgatattaccgctatgtggaaagcgtggaatatcaaaccagagcagcaagtttcattctactgcggcaccggctggcgcgcgtccgaaacctttatgtacgcacgcgccatgggttggaagaatgtttccgtgtatgacggcggctggtacgaatggagcagcgatccaaaaaatccggtagcaaccggtgaacgcggcccggacagtagcaaataacattgcaattactgacgctggagcgacttcagcgtcagatacccactccacacccgcgtaaaggtcgtcatccagcacaacgcaccgaagatccacgcaaaccacgcaaaccatgcagggaataaacatcccagcacaaacagtaagatcgtttctgtgccttcggttaatccccccagatagtaaaacgacttatgtgcataaccggggttatcaatctgatgttttgctgccagtgcagcaaaggcgagaaaactgctgcccgtgccgataaacgcaaacaacaaccagccgcctgccagcgcattttgctccggtgcagcaagaataaagccaaacggcaccagcgcgtaaaagagaaaatcgagagaaatatcaagaaagccgcccgcgtcggtaagctctctgcgccgcgccagcgcaccgtccagaccatcaagcagcctgttcaacaaaatgacgactagcgccgccagataccagcccagcgccagaaacggcagagccagcacgccgatggcaaatcccactaatgttaaaccatctggcgtaatgcccggtttatcaagaacccgcacgcactgatgcaacaacggtttaatccggggatgaagatggcggtctagcacaggcactccttaaatataaagcctttctgattgagcaacagtgcggatattatggcatttttcgcttatctgcccgtgtgtaatttatgaaaatgattgaagttgttgccgccatcattgaacgtgatggcaaaattttactcgcgcaacgccccgcccagagcgatcaggcgggattatgggagtttgccggtggtaaagtcgagccggatgaaagtcagcggcaggcgctggtgcgtgagttacgcgaagaactgggcatcgaagcaactgtgggtgaatatgttgccagccatcagcgagaagtttcggggcggattatccatcttcatgcctggcacgtacccgacttccacgggacgttacaggcacatgaacatcaggcgctggtctggtgctcacctgaagaggcgctgcaatatccgctggcccctgctgacattccattattagaggcgtttatggctttacgcgccgccagaccagcggattagtgctaagggttttgtcatcacgctggcattgcagcagtattccttcggctttaattaccgccccttcagaataattttgatcctgataaacgcagcactgagtacagggctgcgctgactgcccgcctgaactgaacacttctggcggtacgtttacctccacgtccggacgataatgcgggttagccagtgcaattaatggaaatgctaatactacggcgaacaatgctcgactcacagggaactccttaacgttattgtctctgctactgataacggtagccgggtggcaaaactttagcgtctgagttatcgcatttggttatgagattactctcgttattaatttgctttcctgggtcatttttttcttgcttaccgtcacattcttgatggtatagtcgaaaactgcaaaagcacatgacataaacaacataagcacaatcgtattaatatataagggttttatatctatggatcagacatattctctggagtcattcctcaaccatgtccaaaagcgcgacccgaatcaaaccgagttcgcgcaagccgttcgtgaagtaatgaccacactctggccttttcttgaacaaaatccaaaatatcgccagatgtcattactggagcgtctggttgaaccggagcgcgtgatccagtttcgcgtggtatgggttgatgatcgcaaccagatacaggtcaaccgtgcatggcgtgtgcagttcagctctgccatcggcccgtacaaaggcggtatgcgcttccatccgtcagttaacctttccattctcaaattcctcggctttgaacaaaccttcaaaaatgccctgactactctgccgatgggcggtggtaaaggcggcagcgatttcgatccgaaaggaaaaagcgaaggtgaagtgatgcgtttttgccaggcgctgatgactgaactgtatcgccacctgggcgcggataccgacgttccggcaggtgatatcggggttggtggtcgtgaagtcggctttatggcggggatgatgaaaaagctctccaacaataccgcctgcgtcttcaccggtaagggcctttcatttggcggcagtcttattcgcccggaagctaccggctacggtctggtttatttcacagaagcaatgctaaaacgccacggtatgggttttgaagggatgcgcgtttccgtttctggctccggcaacgtcgcccagtacgctatcgaaaaagcgatggaatttggtgctcgtgtgatcactgcgtcagactccagcggcactgtagttgatgaaagcggattcacgaaagagaaactggcacgtcttatcgaaatcaaagccagccgcgatggtcgagtggcagattacgccaaagaatttggtctggtctatctcgaaggccaacagccgtggtctctaccggttgatatcgccctgccttgcgccacccagaatgaactggatgttgacgccgcgcatcagcttatcgctaatggcgttaaagccgtcgccgaaggggcaaatatgccgaccaccatcgaagcgactgaactgttccagcaggcaggcgtactatttgcaccgggtaaagcggctaatgctggtggcgtcgctacatcgggcctggaaatggcacaaaacgctgcgcgcctgggctggaaagccgagaaagttgacgcacgtttgcatcacatcatgctggatatccaccatgcctgtgttgagcatggtggtgaaggtgagcaaaccaactacgtgcagggcgcgaacattgccggttttgtgaaggttgccgatgcgatgctggcgcagggtgtgatttaagttgtaaatgcctgatggcgctacgcttatcaggcctacaaatgggcacaattcattgcagttacgctctaatgtaggccgggcaagcgcagcgcccccggcaaaatttcaggcgtttatgagtatttaacggatgatgctccccacggaacatttcttatgggccaacggcatttcttactgtagtgctcccaaaactgcttgtcgtaacgataacacgcttcaagttcagcatccgttaactttctgcgatagcagcagatatgccagtaaagaaatcccatttgactatttttttgataatcttcttcgctttcgaacaactcgtgcgcctttcgagaagcaagcattatataatgccaggccagttcttcttcaattgtcccgttttgaaaagctgtgcttgatatcgagatcatccatgataattccgccgcccatattagcttcgccgaggatttaccggagctatgattagcgcaatcagagatatagtctgagggaaaaacagcaaatttattcaacaaggcgataacctgctctggggcttcctccatgtttgctttaaaggtattggctccatggtcgccagaaagaaaatgctccattaaggcacaataactttcgctatcttcgataccccattgatcctctaaagactcgcgtcttttacttatgatatcgatcgagtcaaaaggaagcacatgatattggaaggtatctttgccaggttcaggctttcgcggccagaactccagcgtttcagaccattgcttatgatagaatcgataaggtgcgatcaattgtagcgcctgtaacttctcgatactgagcggctcaatacctttagcctgataataatgcagttgttctttttttgctttaaaaccggcccgaacaataagccccatcataattaatagataaagaaaagagcatcccgcggtaatcaggcctctttcattcaaaccgttggatgttatcgctgcgaacacaaacattacagcgacaacacatgttaaataaaacccccacttacaaagcagcatggccttattttctttaatcatccgttcaaaattactattaaatatttcccagccattaaaagaatacttctcgctcccaggatggttttgtaataaaacttttttcatcacattccctgttattacatactttagaggcgataattttatccatgcaaaaaaaatatccaacgaattttcttgatccgctggatatttcagaatatgactcgaatagcacgaaagattcactcgcttacgctatcgccccgcttccgacttcatctgctggcggactttttttcgcactacgtttacgcggtgcagcctttttcttatcagcactgccaccactgcccggagccacaatgccgcgaaactgccgcaccggcgtacgtttggcttgatcaataagctgatatagcgtccccaccagcggctgcataaagtcctgatagcgacactgcttttcgctgatttgcgtcagcaccgattcccagtgcgcggtcatgtccggtcgcgtcgccatctccggcagcgaatggaatagcgcttttccggcgtcggtggagtggatatagcgcccttttttggtcaggaaaccacgcttgaacaacagttcaataatcccggcacgcgttgcctctgtccccagaccatcggtcgcacggaggatctttttcagatctttatcctgcacaaagcgcgcgatcccggtcatcgccgaaagcagtgttgcatcggtaaaatggcgcggcggctgggtttgccgctctaccacttcacctttttcacacagcaactcatcgcctttcgccaccacaggcagtggcgtgccgtcgttttcttcatcgcgctctttgctgcctaacagcgtgcgccagcctgcttcagcaagaaaacgcgctttagcgacaaatttgcctttggcaatgtccagttcgataacacacttgcggaacaccgcatccgggcagaattgcatcagatactgacgggcaatcaggttatagaccttcgcttcgttctccgtcaggttgatcgcagaactccgtgcggtcggaatgatggcgtggtgcgcatcgacctttttgtcatcccaacagcggttgcgtatatctggatctaccactggctgcggcaacagatccggtgcatgaacactgatggcattcatcaccgcgtggcgtccggcaaaatgttcttctggcaaatagcgacaatcagaacgcggataagtgattagcttgtgcgtttcgtacagtttctggcagatatcaagcacgttctgcgcactcagaccaaaacgttttgccgcttcaatctgcaacgctgaaagcgaaaaaggcagcggcgcggattctgattcccgtttatcgttatagctggtgacaatagccggttgaccactaatgcggttaaccacatgctccgccagtggacgatgtaacaagcgcccttcttcatcctggtacggttcacacgcttcgctcggttgccagatagcggtaaaccgctcatcggcaggtgtcacgatatgtgctttgacttcaaagaagtctttcgccacgaagttttcaatctcttcatcgcggcgcaccaccagcccaagcacgggcgtctgcacgcgtcccacggaaagtacgccctgataaccggcattgcgaccgagaatggtatacgcacgggtcatattgatgccgtacagccagtcggcacgcgctcgcgccagcgcagaaacgcacagcggtacaaactcactgttggaacgaagacggtcgatcgcccgctcaaccgcctgcgggttcaggtcgtttatcaagcaacgctgtacctgctggcgcttttccggtgccagttgcagatagtccagcacttcatccaccagcaattgcccttcacgatccgggtccccggcgtgaacgatttcgctggcttcatgcaggaaccgtttgatgacgttaagttgtttggtcacggagggtcggggctgtaattgccacttttccgggacaatcggcaaatccgcaagattccagcgcgcatagcggctgtcgtaggcgtctggctgcgcctgctcaagcaggtgaccgatacaccaggtcaccacctgaccattaccgcactcgataaagccatcgcctttccggtgcggtttgggcaggacatcagcaatggcgcgcgccagactcggtttttcggcaataaacaaccgcattgaattaacgaatctcaaccatggcacgaccgccgcgcgctggcaccagttcgccaattgccgtcagttcaatgccaaactcggcggctgtagctttgacctcattttctgcttccggcatgaccgccagcagcaaaccgccagaagtttgcggatcacacagcagatcgcgcacttcacgcggcatttcacccatcagatgaccgtagctggcaaagttacgttcagtgccgccaggtactgcgcccaacttaatgtactcttcaacaccggggagtttcgggatcgcttcatagtcgacgcgtgcctgcacaccagccccctgacacatttcgctcaagtggcccagcagaccaaagcccgtaacgtcggtcatcgcttttacgccttcgatgttggcaaaggacgcgcctgcgatgttcatccggcacatcacttccgtcgccagtccctgatgttctggtttcaacagtgattttttctcagccgtggtaagaacgccgatccccagcggtttcgtcaggaacagtttgcatccggcttgtgcggtactgtttttcttcacccgctcggtcggtacgatccccgttaccgccagaccaaaaatcggctccggcgcatcgatggagtgaccgccagccagcgcaatacccgcctgacgacatgcatagcgtccaccttcggtcacttcgcgggcaatttctggggaaagtttgttaatcggccagccgaggatcgcaatcgccataatcggtttgccccccatcgcgaagatatcgctgatggcgttagtcgccgcaatgcggccaaaatcgaaaggattatcaacgatcggcataaagaagtcggtggtactgataacgctggtgccattgcccagatcgtacaccgccgcatcgtcgcgggtttcattacccacaagcaaattcggatcaacaaacttcgcctgctcactatgcaggatggtttccaacacttttggggaaattttacagccgcaaccagctccgtggctgtattgggtcaaacgaatcgagttctcgctcatggacatctcctgtcaatgcaatccgggtatggtaaccctcattccgtgaagtgataagtgagagtgtctgaattcctgcgcctttgctcacaatccagacagtttcgcgacaattatcagaaataagttacaaacggcgtcgggtccgggacgttaatcgacgtagatgctttcagctgcggcgtaccgaggtagagaaaaccgacaattttatcctgctcacggcaaccgaatgcttcacgcactaccggactttcagttaatgcgccactgcgccagatgccgccaaacccctgggcaactgctgccatttgcatcgccatgaccgcgcatccggcagacatttcctgttcccagcgcgggactttatgattctcttcgcatttcgccaccaccgtgatgatgagcggtgcgcggaacggcgcattacgggctttgtcgatagctttgtcatcactaccggcagcaatcgccccctgttccagtacggcgctgaaacgctcgcgcccttccccttcaatcacaaaaaaatgccacggttgcatggacttatggtccggcgcacgcatacccgcacgcaggatgttttgcagttgttcacccgttggcgcgggttcagccaagcgggaggcgctacggcgattgatcaatagttcgagtgcatccatttgattaactcctgtcgtgatatttattcacaaaattaacacgagagtggattttgttacagcacagtccgcaattcctgctgacaagtaccggttgggtcattacgataaccacatctattgcgcctgtgacaggtgtgaccttaagttgggagaatacatgcgaaccctttggcgatttattgccggattttttaaatggacgtggcgtctgctgaatttcgtccgtgaaatggtacttaacctgttctttattttcctcgtactggttggtgtggggatttggatgcaggtcagtggtggtgattcgaaagaaacggccagtcgtggcgcactgctgctggacatttctggtgtgatcgtcgataaacccgacagttctcagcggtttagtaaattaagccgccagctgcttggtgccagttccgatcgtctgcaggaaaactcactgtttgatatcgtcaacactattcgccaggcgaaggacgaccgcaatatcaccggtattgtgatggatctgaaaaacttcgcaggcggcgaccaaccgtctatgcagtacatcggcaaagctctgaaagagtttcgtgacagcgggaaaccggtttatgccgttggcgagaactacagccaggggcaatattatctcgccagtttcgccaataaaatttggctgtctccgcaaggcgtggttgatctgcacggctttgccaccaacggtctgtactacaaatcgttgctggataagctgaaagtttccacccatgtgttccgcgtgggtacgtataaatctgccgttgaaccgtttattcgtgatgatatgtcaccggcagcccgcgaagctgacagccgctggattggtgagctgtggcaaaactatctgaatactgttgccgctaaccggcagatccctgctgagcaggtattccctggcgcgcaagggttgcttgagggtttaaccaaaaccggtggcgataccgcgaaatatgcactggaaaacaagctggtcgatgcactggcatcgagtgcggaaatcgaaaaagcactgaccaaagaattcggctggagtaagactgataaaaattatcgcgccatcagttattacgattacgcattgaaaacgccggcagataccggtgacagcatcggtgtcgtctttgctaatggcgcaattatggatggcgaggaaactcaggggaatgttggcggtgataccactgcggcacaaatccgcgacgctcgccttgacccgaaagtgaaagcgattgtcctgcgtgttaatagcccaggcggcagcgttaccgcgtctgaagtgattcgcgctgaactggcagcagcccgggcagcgggtaagcctgtggttgtatcgatgggcggcatggcggcatctggtggttactggatttccacgccagctaattacattgtggctaaccccagcaccctgaccggttctatcggtatcttcggcgtgatcaccaccgtagaaaatagtctggattcgattggtgttcatactgatggtgtctcaacttcaccgctggcggatgtttctatcaccagggcactgccgccggaagcgcagctgatgatgcagttaagcattgagaatggctataaacgctttatcacgctggttgctgatgcgcgtcattcgacgccggagcagattgataaaattgcccagggccacgtctggaccggtcaggatgcaaaagctaacgggctggtcgatagtctcggggatttcgatgatgcggtcgccaaagcagcagagctggcaaaagtgaaacagtggcatctggaatattacgttgatgaaccgaccttcttcgacaaagtgatggacaacatgtctggttctgtccgggcaatgttgccagatgcgttccaggccatgttacctgcaccgctggcctcggtagcctctaccgttaaaagtgaaagtgacaagctggccgcgtttaatgacccacaaaaccgttatgcgttttgcctgacctgcgccaacatgcgttaagtcttgtactgagtggccgacagatcgtcggccacattattttttacgtcgacgaatcctcttcccgctgtttcgccccatatttccttatccgcatagtatcaggtgcgctccccctgcctcacgtatatacttttgctctttcgatatcattcatatcaatatcatgcaaaagaaatcaatttacgttgcctacacgggcgggaccatcgggatgcagcgttccgagcagggttatataccggtgtcaggtcatctacaacgccaactggcgctgatgccggaattccatcgcccggagatgccagatttcaccattcatgaatatacgccgctgatggattcttcagatatgacgccggaagactggcagcatattgctgaagatattaaagcgcactatgacgactatgatggttttgtcattctgcacggcaccgacacgatggcgtataccgcctctgcgctgtcgttcatgctcgagaatctcggtaaaccggtcattgtgacagggtcacaaatcccgctggctgagttacgctctgacggacaaattaatctgctgaatgcgttgtacgttgcggcgaattatccgatcaacgaagtaacgctctttttcaataaccgattgtatcgcggcaaccgcactaccaaagcccatgccgatggttttgatgcgtttgcctctccaaaccttcctccgttactggaagcaggtatccatattcgtcgtttgaatacgccacccgccccgcacggtgaaggggaattaatcgttcatccaatcaccccacaaccaattggcgtagtgacgatttatccagggatttctgctgacgtcgtgcgcaattttctgcgccaaccggtgaaagcattgattctgcgctcctatggcgtgggtaatgcgccacaaaacaaagccttcctgcaggaattacaagaagccagcgatcgcggtattgtggtggtcaacctgacacaatgtatgtccggtaaagtgaacatgggtggttatgccaccggtaacgccctcgcccatgccggcgtaattggcggtgcagatatgactgtagaagccacgctaaccaaactgcattacctgcttagccaggaactggatactgaaaccattcgcaaggccatgagccaaaacctgcgcggcgaactgacgccggatgattaaggagactgtaatgccccctcgcgccctgttactggtcgatttacaaaatgatttctgtgctggtggcgcgctcgccgtgccggaaggtgacagtacggtggatgtcgctaaccgcctgattgactggtgccagtcgcgcggtgaagcggttatcgccagtcaggactggcacccggcgaatcacggcagttttgccagtcagcacggtgtagagccttatacgccaggccaactcgacggtttgccacaaaccttctggccagatcactgtgtgcagaacagtgaaggcgcacaattacatccgttactgcaccaaaaagcgatcgcagcggtgttccataaaggcgaaaatcctttagttgacagttacagtgccttttttgataacggccgtcggcagaaaacctctctcgatgactggttacgcgatcatgaaatcgatgaattgatcgttatgggcctggctactgactattgcgtgaagtttaccgtgctggacgcgttacagttaggttataaggtaaacgtgattaccgatggttgtcgtggcgtgaatatccagccccaggacagtgcgcacgcgtttatggagatgtcagcagctggggcaacgctatatacgctggcagactgggaagagacacaggggtaattttacgctggcctacaattctgtactggcattgtaggccaaataaaacacgtcagtggcacatctggcaattgatgccatcaacgaaagatttaattcacctcagaaatctcttccaacgacaccttccgcgtttcgatgccaaaaatggagagaaccagcgcacagagcaataacataacaccaagtaccataaacaccgtgatcgacccataatgtgttaataatgccgcaacgccatagggcgtgaagactgcgacgatccgtccgacggcattaacgaaacccgaaccgcgcaggcgtaaatgcgttggccaaagctccgggatataaaccgccgacgcgaagcaaacatacatgtataaaaagaagatcatcaccagtccatagattaaaatcgcccactctgtagtctgaattgaatagatatagcctaacacggcaataataataagtaaggtggagccaaataaccgacgaggaaaatgatcaataattaatgccgcaataaatattcctaccggagcgccaatcataataacagcggtcattaatattgatttatcgacatcaatgccggagttaacaaatatggtcggtatccatacggtgatggtataaagcgaaatgttcattgcaattaaaacagtaatcgcgactaatgtacgtcgtaacatttcacctttaaacaggagccagaaagtacccttgattactttaaccttgctgttgctctgatacgaagtaagcgggggtaaacgaatactcttctctctttcaatttgctgctctacttcacgaagttggcattctgcacctgcgatttgccctttccctgccagccatcgtggcgactcgataaagtatttacctgagagaaaccaggctaacagtatgccaataccacccagcagaaacattattcgccaactaaaaaaagcgataaccaccacgcctatcgccgcagacagcatgggcgaccagttaccaacaaatgagagccgcgcggaccattttccacgcaccgtcgcggggataaactccgtaaatgaggcatagccaaccataatcagcgcccccattcctgttcccatcaggaagcgaaagaagatgagccagtacatatcagggacaaaagcggcccctgttgcagcaataccgacgatgagaagatttatgcgaaacgccctgcgccgcccaaagtagtcaccaataaacccaccagtaagtgagccgatgaaataaccaaacattaatgccgaggtaaaggcggcattgaggaaattatttgaccatccattgcttaccagctttgctaagacgacattaccggagtaactcaaaaaccctgttaataacagactaaagcttataataccaaatatacgataatgaaaccgggccaaaggcaagcggtccagtcttgcgccaatttgatcatattgttccattaggtgcctcggatttgctaaaaaggtagcaattgcggcaaattcacttgccgcatctttatcatcattttatttcaaggcgcaggaacaaataatattgacaacgtgtgcttaaattaccacaccagctggatattattgtctttgcaaaatgctatccactctgcacccggtgatttatcagttattatgtaattaatatgactaaaatcagctaactggacaaaagctttgcgatcaaacttagagtgatcaaccaataacgcaacttctgtcgcctgacggatcattgtctttttgatttcagcttccgcttcattagagtccagcgcgccgctgttaatatcaagacctttacaactcattaccatgatatcgacatgatagcgcctgatgatctctttagtaattcttccttgcagtgaaagtgtatttttgtttagttccccacccgttgaaacgactttaatttctgactgagccagaacatgaatcgcttccgccgagttggttagcaacgtcaggccactacggtcctgtaacaatttgagcaattccattacggtactactggaatcggctgccatggtggttttattgtcgataaagggtagtgccttgcgtgcaataagctgcttctcttcataaaacgatgaagcgcgcttataaaaatggatattctccgtcaacatcgctgtatttaaaacagcaccaccataggttctggtcaaaaagccttcatcttccagcttctcaagatcgcggcgaatggtttcttcggttacctgaaaaatcccactcaaatttgagactgtcacctttttatcgttggcaaccatttgcttaattgcctgaatcctgtcttttgccgccacgattacacccctgtatctttttacatcacattagcgcgattatcgcataaccgatgtttactttcaaaataacctgtttgaatcacagattttcatcacagttttcacagaaacagaggtgaatcgtgttgagtatttaacgctccagggcctctgccatttccctcatcaatgttgcgtctgcatccgataagttgatattcagtgccgcgacattttcgcgtacctgttccggtgcagtagccccactaagaatggagattaaatcactctgttttaatatccacgccagtgccagagtgggaattgtgcactgataacgagcacaaagtggctgccactgttcaagcatatcaatcactttcagcatgttttcacgctggaaccagactttatttgcccgagcgccgcccggaacgtaatcacgagtgatggtgccggtcaacaatccctgctctagcggggaataaacctgaaccacaatgccattatcacgacatagtggcagcagttcgttttccattgcccggtcgaggatactgtatttcgcctgaataatatccagttcaccatattgcagatactcgcggatatggtcagcatcgacgttagcagcgcctatagcgcgaattttcccttcagactttaactcattaagcactgcgacagtttcagcgatcggcgtaaaaaatggcggcaccgactgccagtgcgtcatgtagatatcgatgtaatcaatacccagacgttgcaagctcgctgctacctcttcgcggatagattccggggaaaggtttttatacaactgccgatcgccaactttgttgaataaacttccttttcgttcccagacaatgccgcatttggtttctactacaacctgttcacggggcagtttttttaacgcctgaccgacgataacttcactattgccaaagttatatcctggcgcagtatcaatcagattaatgccacaacgatgggcttcaagaatcgtatcaatacatatttgccgatcgagatcgccattccatgcaggaccgccgccaatggcccatgtccccaaccccattcgcgaaagcgtaatatccgttgtgcctaaaggtatctttttcatttgccttcattatccttcgtattcttccagcaattgttcgaccagctttctgttttttacgccggtggtggcaccgacgcttagaaccgagatagccgccgttgcattggcaaagcgtgcgcattcacgcagatttttgccttctaacagtgccgcaataaaacctgaagcaaagttatcgcccgcgccaatggtgtcgatggcggttattcctgcgaccgccggcaccttcatcgtcatgtcaccacgcttgataaagcagccgtctttacccgttttaatcaccaccgtttttacgccgcacgcaagaaagcagtcagcaatttcatccagtgtctctttcccggtgagtaattttgcctcggcaaaattaggaaacagataatcgacataactcaatgcttcgcaaatatcatccagcgtttcattcaaccgcggtttgatcatatcggcacagataatcatctgccgggctttagcttgcgtaaaaatttctgttagcgctttaccatccaatagtggactgttgaaaatactggccagtgataataatttcgcctgagaaaaccgcgcaaaatcaacatcgtcaatattcaatttccacagactgccattacggtttgtgacaaacgtccgctcgccatcctccgtcaccagtccaacgttaatagaggtatctatgctgacgtcctgcttcaggctttgaatatcaatattctctttgcggcaatggtcgagaataaattgccctgcggcatctttaccaatacgactcattaatgctgtgcgatggcccagacgagaaataattgttgcttcatttattgcatcacccccggtggtcattgcgattctttcaagaggataagaatccacatcaaagatatttttactgaccggttgcaatggaatatcaacaatagcggcacctatacaaataacgtcgagattatccatatcattattccgctttgccatcagaaccgaacagtttaattttttccaatgcccgttcttttacagctttacgtacttcacgttctaaatgcaggaaaggctgatcctggttttctttcactgcaaccattgcggcctgacagagctccgtatgaatgttgattttcgcgatacccaacgaaattgcagttttaatgtcggcatcactgatccccgatgcaccgtgcaaaaccagcggaacagaaacggcatcgcgtacgcgtttgacgacctcaaagttcaattgtggctctgacgtataaaccccatgctggttgccgatggcgacagccaatgaatcacagcccgtacgttcaacaaattcagccgcctggtcaggatcggtatagtgatagcccgccagcgcttcctcataaacggtttcattaccgacatgccctaattccgcctctaccggaatacccagcggatggaagaaatcgacagcctctttggttaaacgaatattttcttcgaaatcaaacgcggaagcatcacgcattaatgaattcataccatgagtccaggcgttatgaataatctccatactccgaccatgatcccaatgagttattaccggcaccgttgctttttgtgccattgataccatcatgtgagagaaatcttcaaatgaggtgttaccgacaaaacctgtaccaaaagaaataataaccggggatttcgcttcttcggctgcgtcgataacgcccatcaacatttctgcattccatacgttaaaatgggcaattgcataatgtttatttgtggcatcgttttcccaatatctgatatctgcgagcatgttctgttctcccgtattaattaatcgctaattttaataacgcctttaataatgtcgcgtttgttgttaactgactcttcaaatgcctgttgtacatcccgataatcgtaaatatgcgtcaccatcgatttcacatcgaatcgccctgaagaaatagcttcaatcgtgaccggataacgattggcatagcggaataccgtctggatagtgacttcgcgattgattttgaggaaattgattgccgaatcgccgggtacagtaccaacaatcataattttaccgccgcgcattaccagataaggtgcctgtttaacggtgaccgcagaacccgctgtttcgaaaacaatatctgcgcccatgtcttcggtaaattgctgacagcgtgcaatagtgtcttcttttgcgccgttaataaccactgtcgcaccaagctgttccgccattgccagacgtttttccagcacatcaacgacggcaatttccgttgctcccaggcatttgcacgcttgcaacgtcatcaaaccaatacaacctgctcccagaataattatcttcttacccggtttaacatctgccagcatcgcggcatgcatcccgactgcggcaggctccaccagcgccccttccatcgtgtccatattgtcgggcagtttgtaagtaaagctctccggatgacacagatagtgcgttaatgcgccgcggtagttgggttgtgtcgccataaaatcaacgtccgggcagatgttatatttgccttccagacagtaacgacagtgaccgcaaggaacgccaggttcgatatttacccgatcccccggtttaaatttgcgcacgcggcttcccacagccacaaccgtcccggcgcattcatgacccaggccaatttcttgatttgggtctttaggcggaataaacgggcctgattcaaaaccatgtacatctgaaccacaaataccgacatattctactttaatcaaaacttcatcttctttaggcactggtatttctgctgaaataattttcattgtgcccggcacctgcaatattgcttttgaatttttcattttgaatccacccgtattatttattggctactgcatcaatacttaaactttcaacggagacacctttggtttcgattccaatggtggcgatagcaattgcgacaataattgaaaccgcccccagaagaataaagactcccgtaacgccataactactgagcagcactgcaacggcataaggtgcggcaataccactgattcgccctaccgcattcgccagaccggagccacggagtttggcctctgtcggccagatttcagggacatacactgccgaggcatagcaaacgtacatatagacgaaagtaatcaggaagaaaccaatcaacgttatgagcaacatactggtttgcagtgaatagatatatccgagcaccgcaatcaggattaatagccccacacccattgttttacgcggaattttatccatcaccagcatggcaataaaaataccaaatggcgcgccaaacatactcatggtatttaaaacaatcgagtcttttaaattaatcccctgggtcatgaatattgttggcaaccagttaattagtgtgtactgcacaacgttcatggcaatcagcacacaagagcctaatatcacgcgtttcagtaatactcctgtcagtaaggctgaatacggcaccgcttgtggcgctttaccgtcatcagcaataaccacaggcggcaaaggtttacccgtctggcgtatgacgccttcttctatactccgcatgactttctcggcttcctgataccgtccgcgcgattccagccagcgcggggattcaggaaagtagcgccaggccagcgccgtagcgataagcgacaatattgcagggataagcagttgtacccgccagttccactctgcactaatcagcggcgtgagtcccatcgctatcaatgaacagagcggatatgaccagttgccaataaaggaaacccgacttgaccacgttccacgatttctaccgggcatatattcggtgaaaccagcaaacagcgtaaccagtaaagctcccagcccaactcccatcacaaaacggcaggcaataaggaaatccatattcggtgagaaagcaccgacaaccatcgaggcaatatgaatggcctcatagaggatgaacgcatttctgcgaccggttttgtcgccaatgatgccgcccaccagcgcaccgagaaacattccggcggtcgtgattgctgagaatgtggctgtggtggaattatctgtccagcccaacgctttcagctgcgcgaggatcaagccaccaacggcattactccagcagacaagcaagccaaacgcgacgatggcaaacattgatgaatgccagcggcaatccggtaagcgatccagccgtgcaccacaatgcggttttgttatctgttccatgcgataacgttccttcaggagagtggttattcatcaaagtcgtaagtcatgatcactttgattgcggttttatcgaccatcgcatcaaacccttcgcgccattgcgacaggccgatacgatgcgtgatcatcggtttgactttgatagcgccgctggctaatagcctgatagcgttacgccatgaggtggagtcataggccatatgcccaatgatgcttttgttccaggcggtaatgtcattaatcgagaaatcaagaggtttgaagcccattccaacgcgtaccacttccccgttcgggcggagcatttcgatggcttgtttcagtgcgatattggcaccggagcattcaatcaccagtcccagattgtctttgccacaaatttgctggcagcgcgccaccacatcttcggtagaaccatttactactgccgtcgcacccagttcttttgcaaccgggaagcggaccgccacatcttcttgcagaccaacgacgacgatatttaccgcccccataattcgcgccatttgtacggagaacagcccgagtgggccagtgccgatgacgaccacatcctgaccaggaaggaatttcgattgctgcgcgatggatttgtaggcattacagatagggtcaagtacggctgcgtcctcataatcaacaccatcagggatttcccacaacgcatgacgatgaattttgagaatttcaccaggaaccagacaatatttggaaaaaccaccgccccaggtattattatccagaccaaggtttactttttctgtacaacacagaaaatcaccttgttcacaggccggacaaacaccgcaaacgtgaccgctgttatccgatacgacgcgttgccccactttccagtctttgactttttcaccaacctgcgcaatacaacctgcgaactcatggccgcggatagagttaaactcatcagaaccgctatcgacattgtagtgcttcatgtctgcgccgcagattgccgcggctttaatttcaatcactacatcttccgggccacacatgggttgtgggacatcaatcatcttgtagccgccaaaggccttgccaaaccgagccagtgctttcattgcgtcatcctctgtgtttagttttgcttagatggccatcatacttacccacatgatttttgaggtcaacattaaatctgtaaaacacagataatgatctgcgttttacaactcagatcacaattacgcagaaaatggctgggtctgttacaggttgatggaaggcggggcgcaaaaagagcaaattcgagagggattaccggccaaataggtctgagacttaagttcaggagaagtcattcaggtgtgaacgggacggcaagagatcggactgggacttagccaggtcatggcgagataattgagatgagtcgtggggtcattgttggctatccccttcatagccgaggcaaaaaggggatgaaccacttacttaaacatggcaataggctttgctgagataccaaaatcttcttttaactgctgtttgctcttcatgaccatctgaccatttgtgtcaattgtcatatgctgtgcttcgatattatggcgggcttgccacagcatcaccagttgcaggcagttctctttttgttcctcggtcaacgcaacgccatcaggccatttccccagttcaacggcggtcgacaaacgctggtatacctcaggcatcatgctgttgataatgtcatcaagattcataatttttccgctcctgtggaataagttgctgaatcgttttttcaaccgttgatttcttcgccgttttcgccatcggtaaagcgtaaagaggcagagttaacacaataacgttcgcccgttggctgcggcccgtcggggaagacatgccccagatgggcatcacagttaccgcaacgaatttctatgcgctgcattccatgtgacaagtctttgatataacgaatggattcttcacttaccggttcgtagaaactgggccagccacagccggaatcatacttggtttgggaatgaaacagcggggcatcgcagatcaaacagtgatatacgccgtcacgcttgttatgcagtaaacgacccgtaaatggcggctctgtcccatgattctgcgtcacgtaaaactgcatctcggacaaattttttttcagttcttctgccgaaggtttattagccatttgctcacatctcactttaatcgtgctcacattacgtgactgattctaacaaaacattaacaccaactggcaaaattttgtcctaaacttgatctcgacgaaatggctgcacctaaatcgtgatgaaaatcacatttttatcgtaattgccctttaaaattcggggcgccgaccccatgtggtctcaagcccaaaggaagagtgaggcgagtcagtcgcgtaatgcttaggcacaggattgatttgtcgcaatgattgacacgattccgcttgacgctgcgtaaggtttttgtaattttacaggcaaccttttattcactaacaaatagctggtggaatatatgactatcaaagtaggtatcaacggttttggccgtatcggtcgcattgttttccgtgctgctcagaaacgttctgacatcgagatcgttgcaatcaacgacctgttagacgctgattacatggcatacatgctgaaatatgactccactcacggccgtttcgacggtaccgttgaagtgaaagacggtcatctgatcgttaacggtaaaaaaatccgtgttaccgctgaacgtgatccggctaacctgaaatgggacgaagttggtgttgacgttgtcgctgaagcaactggtctgttcctgactgacgaaactgctcgtaaacacatcaccgctggtgcgaagaaagtggttatgactggtccgtctaaagacaacactccgatgttcgttaaaggcgctaacttcgacaaatatgctggccaggacatcgtttccaacgcttcctgcaccaccaactgcctggctccgctggctaaagttatcaacgataacttcggcatcatcgaaggtctgatgaccaccgttcacgctactaccgctactcagaaaaccgttgatggcccgtctcacaaagactggcgcggcggccgcggcgcttcccagaacatcatcccgtcctctaccggtgctgctaaagctgtaggtaaagtactgccagaactgaatggcaaactgactggtatggcgttccgcgttccgaccccgaacgtatctgtagttgacctgaccgttcgtctggaaaaagctgcaacttacgagcagatcaaagctgccgttaaagctgctgctgaaggcgaaatgaaaggcgttctgggctacaccgaagatgacgtagtatctaccgatttcaacggcgaagtttgcacttccgtgttcgatgctaaagctggtatcgctctgaacgacaacttcgtgaaactggtatcctggtacgacaacgaaaccggttactccaacaaagttctggacctgatcgctcacatctccaaataagttgagatgacactgtgatctaaaaagagcgacttcggtcgctcttttttttacctgataaaatgaagttaaaggactgcgtcatgattaagaaaatttttgcccttccggtcatcgaacaaatctcccctgtcctctcccgtcgtaaactggatgaactggacctcattgtggtcgatcatccccaggtaaaagcctcttttgcattacagggcgcacaccttctctcgtggaaacctgcgggtgaagaagaagttctgtggttgagcaacaacacaccgttcaaaaatggcgtcgctattcgcggtggcgtaccggtttgctggccgtggtttggtccggcggcacaacaaggtctgcctgcgcacggttttgcccgcaacctgccgtggacgctgaaatcacatcatgaagatgctgatggcgtagcgctgacttttgaattgacgcaaagcgaagagacgaaaaaattctggccgcacgactttacgctgttagcgcatttccgcgtgggtaaaacttgtgaaatcgatcttgaatcacatggcgaatttgaaaccacctctgccctgcatacctactttaacgtgggtgatatcgctaaggtaagcgtcagtgggctgggcgatcgcttcattgataaagtgaatgacgcgaaagaaaatgtactgaccgatggtattcagaccttccctgaccgtaccgatcgcgtgtatctgaatccacaagattgcagcgtgattaatgatgaagcgctgaatcgtattatcgccgtaggccaccagcatcatctgaacgttgtcggctggaacccgggaccggcgctttcaattagcatgggcgatatgccggatgatggctacaaaacatttgtttgtgtagaaacggcttacgcttcagaaacgcaaaaagtgaccaaagagaaacctgcacatctggcgcaatccattcgcgttgcgaaacgttaatttacgttaatgttgtgtgccgggtgcaatgcatccggcacacaacatcacaccatatccagcgcagtttttccttttggtgccggatatgccttatccagcatagctaattccgctgaagaaagttcgacctcaagcacagccgcattttgttggacatgggcaatcgtggccgcttttggaatcgccatcacaccctgatgactgatcacccacgccaacaatacttgtgccgcgctgatattgtgagcatgtgcaatttcgttgactaccgcgttttttaacagtccattgcgcaaccgcccggcctgggctaacggactgtaagccatcaccggcatctgctgttgctggcaccaggggagtagatcgtactcaattcctcgtgaaccgagatggtaaagcacctgattagtggcacactgatttccccccggcagctgccagagttcctgcatatcagcataatcaaggttagaaacgccccagcggcggatttttccctgggcgatcaatttttccatcgctgcgacagtctcttcaaaagcgaaactgccagaccagtgtaataagtaaagatcgagataatcagtattgagacggcgtaaactggcttcgcatgcatttatcgctttttgcccgccagcattccacggatagactttagagacgagaaagaccttctctcgcagaccggttaatgcttccccaaccaccttttcggcaccgccatcggcatacatttcggcggtatcaatgagggttaaaccgagttcaatgcccgcgcgtagtgcagcaacttctgttttgcgctgactggcatcttcgcccatataccatgttccctgccctacggctggcagtgagacatcgccactaaattgaatcattttttgttgcattgtttcctcccaggtattgcaccaccgtaatgcaaaacagggcgtgacgccctgtttttatgcacaaaatgccctggaaagatgcattatcagaatttgtaggtgatcccggtagaaatcaggccagtccaggatttatccaccatcgggctgtcagtaacttcatcagacagacgggtgtagcgtgcggtaccgtaaacactccagtcgccgaggaagttgtagctggcgctcagctccaggtaagggctccagctgtcgttcgggttatagccacgcagaccgctgcgagcggactctttgcgcgatacgccataatagtattcgttctggttttcgctgttccactgcacaccaatacccggagtcacggtcaggccaccgttggtgtaacgatacaaccaggccatatcccagacgatgccgttgctgttatccagggtatcgccagccagggtggtacgcaggtaaccgtactgggtaaagtgagcataagacagaccagccatcatggtgctcttacggtcatccaggtgacgcatttggtgatcgccactgtctttcgctttgaagtaaagcggcgaccagtaagcggtaattgaaagtttatccgttgcgtcattccacaggtagtaaccaccacctaagccacggaaccagaagttatcgccttcatagttgattaccggtactgggtaaacatcggtatcgtaatctttatatgggtgttcaacgacacctacgcctgcgcccagggaaaatttaccttcagcgtgcgctacgcctgcagacgttgcgataagcactccaagtgccagaagtttgagtttggtcacaattaatcattccttaaacaaatgtttagcgggcgacaaagtttacccgtcaatacatcgaaacccaacctttttacgttttcattttttaaagtaactgtttaattttcctgacgcggatgacaccgcgcttacagccaaatgaatttagcgttactggcgagcctggtctttacattaattatgcaaaatttatggatgagttgttgatatgccattgaaattaagaaagccgtgcaggcaagttttccatttgccatctacgcttaattttgaaggtgtatcaccgggcacgttgttctcatcgtcgataaaatggcatgagagttgctgtgttttagcaagagacgtcgttcagtttacctcttccgggagcctctactattcatatgaacggctcttaacctgtgctaaaaaacgaaaggacggcataccatgaatatattcgatcactatcgccagcgatatgaagctgccaaggacgaagagttcacactgcaggagtttcttaccacttgtcggcaagatcgcagtgcttatgccaacgcggctgagcggctattgatggctatcggtgagcctgtcatggtcgatacagcccaggaacccagactttctcgactcttttctaaccgggtcattgcacgttatccggcgtttgaagagttttacggcatggaagacgcgattgaacagattgtctcttatctgaaacacgcggctcaggggctggaagagaagaaacaaatcctgtatctgctggggcctgtgggtgggggtaaatcatcgcttgctgagcgactgaaatcattaatgcagctcgtaccgatttatgtattgagcgcgaacggtgagcgtagcccggtcaacgatcatccgttctgtcttttcaatccgcaggaagatgcgcagattctggaaaaagagtatggcattcctcgccgttatctcggcaccatcatgtcgccgtgggcggcaaaacgcctgcatgaatttggtggcgatatcactaagttccgggtagtgaaggtctggccgtcaattctgcaacaaattgctatcgccaaaacggaacccggcgatgagaacaaccaggacatctccgcgctggttgggaaagtcgatattcgtaaactcgaacactacgcgcagaatgacccggacgcctacggctattccggtgcgctgtgccgcgccaatcaggggatcatggaattcgttgagatgtttaaagcaccgattaaagtgctgcatcccttgttaaccgccactcaggaaggtaactacaacgggacggaaggtatctccgccctgccgttcaacgggattattctcgcacactcgaacgagtccgaatgggtcactttccgtaataacaaaaacaacgaagccttcctcgatcgtgtttacatcgtgaaggtgccgtattgcttgcgcatttccgaagagatcaaaatctacgagaaattgcttaatcacagtgaattgactcacgccccatgcgcccctggcacgctcgaaacactgtcacgtttttccattctttcgcgcctgaaagagccagaaaactccagcatttattcaaagatgcgggtttatgatggcgaaagtctgaaagacaccgatcccaaagccaagtcgtatcaggaatatcgtgactacgccggtgtcgatgaagggatgaacggtctgtcgacgcgttttgcgtttaagatcctctcccgcgtgttcaacttcgatcatgtagaagtggcagcaaacccggtccatctgttctacgtcctggaacagcagattgagcgcgagcagttcccacaagagcaggcagaacgctatctggagttcctgaaaggttatctgatcccgaaatatgccgagtttatcggcaaagagatccagacggcctaccttgaatcctattccgaatatgggcaaaacattttcgaccgttatgttacctacgcggatttctggattcaggatcaggagtatcgcgatccggataccgggcagctgtttgaccgcgagtctcttaacgccgagctggagaaaatcgagaaaccggcggggatcagtaatccaaaagatttccgcaacgagattgttaacttcgtactgcgcgccagagcgaataacagcggacgcaatccgaactggaccagctatgaaaaactgcgcacggtcatcgagaagaaaatgttctccaataccgaggagctgttgccggttatctcgtttaacgccaaaacgtcaaccgacgagcagaagaaacacgacgactttgtcgaccgtatgatggaaaaaggctacacccgtaaacaggtgcgtttactgtgcgaatggtatttgcgcgtacgtaaatcgtcttaacaaccctggcccggtacacatgttaccgggcctacaacgacagcgaaccgtgggcctgagaagcggcaacacaggcgtagcatacagttggcaaatgtagtacggggggcatatgacctggtttattgaccggcgtctgaacggcaaaaacaaaagcatggtgaatcgccagcgttttttacgccgttataaagcgcaaattaaacagtcgatctccgaggccattaataagcgttcggtgactgacgtcgacagcggcgaatccgtatccattcccacggaagatattagcgaaccgatgtttcatcaggggcgtggcggtctgcgccaccgcgtgcatccgggcaatgaccatttcgtccagaacgaccgaattgaacgtccccagggtggcggcggaggttccggcagtggtcagggccaggccagccaggatggtgaaggtcaggatgaatttgtctttcagatttcgaaagatgagtatcttgatctgctctttgaagatttggccttaccgaatctgaaacaaaaccaacaacgccagctgaccgaatataaaacgcatcgggcgggttataccgctaacggcgttccggccaatatcagcgttgtgcgttcattgcagaactcactggcgcgacgcacagccatgacggcaggcaagcggcgggaacttcatgcactggaagagaatttggccatcatcagcaacagtgaacctgcgcaactgctggaagaggaacgtctgcgcaaagaaattgcagaattacgtgccaaaattgaacgcgtcccttttattgacaccttcgatttacgttacaagaactacgagaagcggcccgatccctccagccaggcagtgatgttttgcctgatggacgtttccggttcaatggatcaatccactaaagatatggctaagcgtttttatattctgctgtatctgttcctcagcagaacgtataagaacgtggaagtcgtatacatccgccatcatacccaggcgaaagaagtcgatgaacatgagtttttctactcgcaggaaacaggcggcaccattgtttccagcgccctgaaactgatggatgaggtagtgaaagagcgttataacccggcacagtggaatatttacgctgcacaagcatcggacggcgataactgggccgatgactctccgctttgccatgaaatcctggcgaaaaaattattacctgttgttcgttattacagctatatcgaaattacccgtcgtgcacatcagacattgtggcgagaatatgagcatctgcaatctactttcgacaactttgcgatgcagcacatccgcgaccaggatgatatttatccggtgttccgtgaactgtttcataaacaaaatgcaacagctaaaggctaaaactatcagccaggtcattatcgcctggctgatttttagcttactgtaaattatctcatttattacatacattagcttacaatcgctttaaatatgacagcataacctttacataatttagttccagaaaacaatcattcggaaaaatgattcagtcaacacgtatttccatggggttattctttaaatattttttatcgttaacgaaaattgatcctggtcaaaactatatatctctgccatcaataaaatccagcactcacattgctctcctttttatggtttctatgggtacacaaaaattaaaagctcaaagcttttttattttcagtttattgctgacgttaattttattttgcattactaccttatataacgaaaacacaaatgtaaaactcatcccacagatgaattacctgatggttgttgtggctttgtttttccttaacgccgtcatttttcttttcatgttaatgaaatatttcactaacaaacaaattttaccaacactcattttaagccttgcatttttaagtggccttatctatttagttgaaaccattgtaattatccataaaccaattaacggcagtacactgatccagacaaagtcgaatgatgtttctattttctatattttccgccaactcagttttatttgtttaacctcgctggcgctcttttgttatggaaaagacaacatccttgacaacaataagaaaaaaacgggaatcctgttgctggcgctgatcccttttttagtttttccccttctggcacacaatctgagcagttataacgctgactattctttgtatgtcgtcgattactgtccggacaaccatactgcgacctggggaatcaactatacaaaaatattggtttgtctgtgggcatttttactgttctttattatcatgcgcacacgattagccagcgaactatggccgttaatagcattattatgtctggcatcgctatgctgcaacttacttctactgactctggatgagtataattatactatctggtatatcagtcgcgggattgaagtttccagtaaactgtttgttgtgtcttttctgatttataacatttttcaggagctgcaactctccagcaaactggcagttcatgatgtgctgaccaatatttataatcggcgctactttttcaacagcgtagagtcattattgtcgcgacctgttgttaaggacttctgtgtcatgctggttgatattaatcagttcaaacgcatcaatgcccaatggggacatcgtgtgggtgataaagtgctggtttcaattgtcgatattatccagcaaagcatccgccccgatgatattttagcgcgactggagggtgaggtgtttggcttgctatttaccgaactcaatagtgcccaggcaaaaatcattgcggaacgtatgcgtaaaaatgtcgaactcctgaccggctttagtaacagatatgatgttcctgaacaaatgaccatcagtattggcacggttttttcaacgggtgacacgcgtaatatctcgcttgtcatgacggaagcagataaagccttacgcgaagcgaaaagcgaggggggcaacaaagtgattattcatcatatttaagtgcaaaaatattcagagccatgctttttgcgtggcttttgcatacaatttattactattacccctaaatttcccctccccagcggcgcagagatgagtataattagcgcccctgtgccaggccgcaatcgaactttatctggttttctcgtttcactaaccgaaggagtgccatttatcatgaaattgcaccatagaatgctccggcattttatcgccgcaagtgtcattgtgctgacatcttccttccttatttttgaacttgtcgccagcgacagagcaatgagtgcctatctgcgctatatcgtgcagaaagcagactcctcctttctttatgataagtatcagaatcagagtattgccgcgcatgtgatgcgcgctctcgctgctgagcagtcggaagtgtcgccagaacagcggcgcgccatctgcgaggcttttgagtctgccaataacacccatggcttaaacctgactgcccataaatacccgggcttacgcggcacactacaaaccgcatccactgactgcgacacaattgtggaagctgcagcactattacccgcttttgatcaggcagtggaaggcaaccgccaccaggatgattacggttcaggtcttgggatggccgaagagaaatttcactattatctcgatctcaatgaccgctatgtctatttttatgagccggttaatgttgaatactttgcgatgaataactggtccttcctgcagtcaggaagtattggcatcgatcgcaaagatattgaaaaggtatttaccgggcgtaccgtattgtcgagcatttaccaggatcagcgtactaaacagaacgtgatgagtttgctgacgccggtatatgtcgcagggcagctaaaagggattgtgctgctggatattaacaaaaacaatctgcggaatatcttttatactcatgaccgccctctcctctggcgttttctcaatgtcacgctaaccgataccgattcggggcgcgacattatcatcaaccagagcgaagataatctgttccagtatgtcagttacgtccatgacttaccgggcggcattcgtgtctcgttatccattgatattctttactttatcacgtcttcgtggaaaagcgttctgttctggattttgacggcgttaattttgctgaatatggtgcggatgcacttccgtttataccaaaatgtgtcgcgagaaaatattagtgatgcgatgactggactgtataatcgcaaaattttaacccctgaactggagcagcggttgcagaaactggtgcaatccggttcttcggtgatgtttattgctattgacatggacaagttaaagcaaataaatgacaccctcggtcatcaggagggggatttagcgattacgttattagctcaggcgattaaacagtcgattcgtaaaagtgattatgccatccgactcggtggcgatgaattctgcatcattcttgtcgattcgacgccgcaaattgcagcacaactgcctgaacgtatcgaaaaacgtctgcaacatatcgcgccgcagaaagagatcggcttctcttccggtatttacgcgatgaaagaaaacgatacgttacatgatgcgtataaagcttccgatgagcgtttatatgtcaataagcagaacaaaaacagccgttcatgataaccttctgtggttgtttgcttgtaatctcaggagcgtgaaatgactgaaatggctaaaggaagcgtgacgcatcagcggttaatcgctttattatcacaagaaggtgctgacttccgcgtcgttacccatgaagcggtaggtaaatgtgaagcggtgtcagaaattcgtggcaccgctctaggccagggtgctaaggcactggtatgtaaagtcaaaggcaatggcgtaaatcaacatgttctggcgatcctcgcagccgatcaacaggccgatctgagccaactcgccagccatataggcggattacgcgcttcgttggccagcccggcggaagtcgatgaactcacaggctgtgtcttcggcgcgatcccccctttcagcttccatccaaaactcaaactggttgccgaccctctactcttcgaacgatttgatgaaatcgccttcaatgcaggcatgctggataaatccgttattttgaaaaccgcggattatttgcgcattgcgcaaccagaactggtcaatttccgccgcactgcgtaactagccggtccgttcgataagaagaacggacaaaaccagtacaacagcaatggcaaaaaacgatgacgtgataatcagtgtctcgacaaacatttgatcgttcatagcatgcccccgggagatagctgttttcacgttattgttagcgtgcacaaatggcagtttgatgacagttcgcctgattttttatgcaaaaaacgtaaagattttctacttccttcctgcagcaagcgtaaagtaagcaggcttattattttttggcaaggaaaccacgatgtttgatgtcactttgctgatcctgctcgggttagctgcgctgggctttatcagtcataacaccactgtcgccgtttcaattctggtgttaatcattgtccgcgtcacaccgttaagcaccttttttccgtggattgaaaaacaggggctaagtatcgggataatcattctgacgattggcgttatggcccccatcgccagcgggacgctaccgccctcaaccttgattcactcgtttctgaactggaaatcactggtggcgattgcagtaggcgtgattgtctcctggctgggtgggcgcggcgtgacgttaatgggcagccagccgcaactggtcgccgggctgctggtaggcactgttttaggcgtagcgctgtttcgcggcgtaccggttgggccgcttattgccgcgggtctggtttcgctgattgtggggaaacagtagttaatctcgcaatatatcggcctggcgtttgccccaggcctttcttaaacatagtaataaaggccgttgttgaatcataccccagcgtatgagcaactttctgtacagtatcgcctttcactaatccctgaagcgccataatcagctgtaactgctgacgccactggcgaaaactcaaccccgtctcttttactatcagtcgggcaagattgcgttcactcatcgcaaaaaagccagcccattgccccaatgccccccactcgacaggccctttcgccatcatctccaccatcgtgcggattttaggatgagaagaaacgggcaggtgcagctgttgttgtggctgctgagggagttcatcaaacaggacctgaattaatctgcgggtcattggctcagcacgctgagtcgtcgtcctgtttgccagggttaaaattaattcccggcataagggcgatattttcaatgtgcaacatgttgtcggcattgtcactgcgctgggttcgataaacagaaaacagagttcagcattagctgttacttgattgctatgttccaccccgcccggtatccaaaccgcatattgtggcggcaccatccacaaagcattttccaccgtacaggtaattgcaccatgtagcgccagtatcagctgtcctttgcggtgctgatgtacaggactggttaactcatccgttccggcgtgaatacaaaatgcgaccgcggcttcatggtgtcggtcgggttcatagccattgagattcaacctgtgcatcattttgtccgaacttagcgataatttgtcattttagcttgattcaacataacaataaaaacggtaaggtacagcctcgtttgtaacaatgagaagcatatgacctgttcaacttcattaagcggcaaaaacaggattgtccttatcgctggcattctgatgattgccacaacattacgcgtcacctttaccggcgcagcaccgttactggatacgattcgttccgcttactcgctgacgacagcgcaaaccggcttattgaccaccctgccattattggcctttgcgctaatctcacctttggctgccccggtagcgcgacgttttggtatggaacgtagcctgtttgccgcgttacttttgatctgtgctggtatcgcaattcgctctctcccttcgccttacttattatttggcggtacagcggtcattggcggtgggattgcattaggcaatgtcttactgccaggattaattaaacgcgatttccctcattccgtcgccagacttaccggcgcatattccctgacaatgggagctgcagcggcactgggatcggctatggtcgtgccgctggctttgaacggttttggctggcaaggcgcgttgctcatgctgatgtgttttcctctgctggctctttttttatggctgccacagtggcgaagtcaacaacatgcaaatttgagtacctcgcgcgccttacatactcggggtatctggcgttcaccgcttgcctggcaggtcacattgtttcttgggatcaactcactggtctattacgtgattattggctggcttccggcgatcctcatcagtcacggctatagcgaagcacaggcgggttcactgcatggtttgctgcaactagccacagcagcacccggtttgctgatcccacttttcttacatcatgtgaaagatcagcgtggtattgcagcgttcgttgccttgatgtgcgcagtgggcgcggttgggctctgctttatgccagcgcacgcgatcacctggactctgcttttcggttttggttccggcgcaacaatgatactggggttgacgttcattggtctgcgggctagttctgcgcatcaggcggcggcactctcggggatggcacaatccgtcgggtatttgttggcagcctgtgggccgccgctgatgggtaaaatacacgatgctaacggtaactggtctgtaccacttatgggtgttgccatactttcactactgatggcgattttcggactttgcgccgggagagacaaagaaattcgctaatatccggtgctatagtgacgtaacaaatcatgcgtgaaagggagaacaaacacgatgaatattcagtgcaaacgcgtttatgatccggctgaacagagcgatggttatcgcatactggtcgaccgcctctggccgcgcggtatcaaaaaaaccgatttagcccttgatgagtgggataaagaaatcacgccgtcaacggaactgcgcaaagcctttcacggcgaagtcgtcgattatgcaacctttcgcgagcaatatcttgcagaactggcgcaacacgagcaagaaggaaagcggctggcggacatcgccaaaaaacagccgctgaccctgctctactcagcaaaaaacaccacgcagaaccatgcgctggtgctggccgactggctacgtagcttgtgattttagtacagcatccggcggttatttttcaccagccggatggtcacgccgccacaatgcccattcatcaatcgtttcaccgcccggtaatttgcaattgttgctgaccccttgcgctgtctgcactggaatgagcgtcccgcccttctgctggcaatagaccgacgccggatttgccataccaatctgcggcggtttaggtgcttctggctgagaaggggttgaacaaccagccaggaccagcaagcaaggcagaacaaaactgataattttcatttattgatctcacatatttatccaagattagagtatcgcggtatcgttttgttttgcagcactatttttattacattcactcaaaacatattacgtcttgtttcatctttgttgatgatgttttatcatgcctgcaaagattaaataatcagcatttacccgccgtatcctggagttgttccgtgtcagatcagattatcgcccgcgtctcgcaatcccttgccaaagaacagtcactggaaagtctggtccgacagcttctggagatgctggaaatggtcactgatatggaatcaacctacctgaccaaagtggatgtcgaagcgcgcctgcagcatattatgtttgcccgtaacagccagaaaatgtacatcccggagaattttaccgtctcgtgggattactcgttatgcaaacgcgccattgatgaaaactgctttttcagcgatgaagtccccgaccgttggggtgactgtattgcggcacgcaatcttggcatcaccacatttctgagcacgccaattcacttaccggatggatcattctatggcacgctttgcgccgccagcagtgagaagcgccagtggagtgaacgcgcggaacaggttttacagttattcgccggactgattgcacaatatattcaaaaagaggcactggttgaacagctgcgcgaagccaatgctgcgctgattgcgcaatcgtataccgactcgttaaccgggctaccgaatcggcgggcgatttttgaaaatctgacgacactgttttccctcgcccggcatcttaaccataagataatgatcgcgtttatcgatctggataacttcaaattaatcaatgatcgttttggtcataatagtggcgatctgtttctcattcaggttggcgagcgccttaatacgctccagcaaaatggcgaagttattggtcgtctcggcggtgatgagtttttagttgtttcactaaacaacgagaatgcggatatttcgtcgctgcgagaacgcattcagcagcaaatacgtggagaatatcacttaggtgatgttgatttgtattatcccggtgccagtcttggcatagtagaagtcgatcctgaaacaaccgatgcagacagtgccctgcatgctgccgatattgcgatgtatcaggagaaaaaacacaaacagaaaacaccttttgtcgcgcatccagcgctacattcctgaggcgtattcacatccttttgattggtgataacatgcgaatcggtattatttttccggttgtaatcttcattacagcggtcgtatttttagcatggttttttattggcggctatgctgccccgggagcataaagatgaaaaaaacaacgattattatgatgggtgtggcgattattgtcgtactcggcactgagctgggatggtggtaacgtcacctctaaaaaatagcaaaggctgcctgtgtgcagcctttgtgcaatttaagcgttaacttttaatcttcctgtagataaatagcacgacaatcgcaccaataacggcaaccacgaagctgccaaaattgaagccatcgactttaccaaagccaaacagcgtgctgatccatccgccgactacggcaccgactatccccagcaggatagtcataaagaatccacctccatctttacctggcatgatccacttcgccagaataccggcaataagcccaaaaataatccatgacagaatgcccattgtttcctcacttatctgttttgcattagcgggttagtcgctgataaaaagcatagcacaacatcgggagggcaagatttgtgacgagcatcacggaggttttttttgcgatggcgcagaaattgcgccatcaacgatcagtgataattaccaaccacaaacatcatgttcgttttccgtgtcataagaacgtacggtattcaccagatcttttatcacttcagccgccacttctggcaccagcaaagtcatcggcgtctctgtttcataatcgacagaaacgccattgctgttattggtgacggtcacggtatacgttgctttgcccatgattcatttcccgttatgaatgactttccgttgttgcgcaccttccatcaggacttcaggagccacgaagaagtcaatgttgaaataagtatcgtcagtcatggcttcaatgttgtgccacttttctggagggaacaccgcaaactgccccgcttcgataaggatcacctgatcaggctctgcactgtgttcatcagcgtagccgagatatttgaccgccccatgcataacggaaaggcgtgggtaaacccccgggcgcgttcctttatcaagatgacgttcgaatattccggcaggtgcagtttgtttattccagaaaggcgttgagcgcgtatgaatataattctgtgggatttgaagcatccttttccctccttcggtgaatgcgctgaaaacggtttattccagccgtttcagggtacgcctgataatttgcattttaaataccatttattggttactttttagcaccatatcagcgaagaatcagggaggattatagatgggaagcccgcgacaacgcgggctgaaagcatcaggattgcagcgtcgccagtcgggcagcgaaacccacgaacatcaaaccaatcagtgagttgccaactttagccagtttctttttggtacgtatgtactgcgtgacaaaagcaccagatataatcaggaagctcaaatagcagaaactcaccagttccagcgtcgccgccagaataaagaatgaaattcccgtatgtggggcattaacatcgataaactgtacgaaaaacgacacatagaacaaaatggctttcggattagtcaggctcaaaattaacgcgcgtttaaaaatagcaccgtattggggctcatcggatttggcctcgctatttttacccttcagggtcgcgtaaagaattttactccccagatagagcaaataaaacgcaccaagataacgtacaatgttgaataatatcggggtggtcttaattaatgtcgccactccagcccatgccagaaacatcaataccgcatcgccaataaatacaccgcaggccgcaagataaccgcctttcataccgctactgacgctatttttgagtacaaacagggtatttggccctggcaccaacacaataaaaatggccccaaccagataggtccagtaattcagaaccccgtattcagcgaacacattaacctctttaattatctttcgatcatgcgcgattaaaggtgaatatgctaaccaatctgtagcggcttagaaaggagaaaatcaggttttaacctgatatcaacccgataattgaatcattaatcaggcatgctccagtgaaaaattcgggtagtgctcggcaaaatactggcgtaaaaattctaccgttatccgcactttcgctgacgtcgccagccttgaaacataaacggcccagacgttcgctggctggtaatattccggtagcacttgcactaaatgaccactggcaatgttttcgctaacatcccaccaggaacgcagagcaatcccctgcccatcgagacaccactgatggacaatttctccatgattagacgacagtgggccggtgactttaatcgcatgggggccttctttattgcgtaattgccagacaccaaaaggatgatcgcgctctttaatgaccaggcacggcaatgcagaaagatcggttaaatgtttcggcgcgccatgttgcgcaataaattccggcgacgcgcagagaatacggtaattggtcgccagtttgcgggcgattaaattaggggcgatgtcatcgccaatgcgaatatcgagatcgacaccttcattgaccaaatcgaccagtcggtcttccacatcaaaacgtaattccagttgcggatacgccttcgccagcgctaataacgccggagccaccacctgtcgtccaaaaccaaagctgctgataatacgcagcatcccctgcggcacctgacgcacgtcagaaagttcgtccatcatctgaccgacatcctgcaaaatccgctgcgcccattcataaatccgctctccttcttcggtaatggtgacgcggcgggtggtgcggtgtaacaacaccacgtttagcgtttgctccagcaaggcgatgcgcttgctgacgaacgccggtgaaacgcccagttcttccgccacggcggcaaaaccagcccggcgagccaccagcataaagacgcgcaaatcattcagcagcggtaaattattcatgattcgtgttttatgtttcaccagttacggggattaattccttttcagtcaattataggatggtgatgttgtcaattttgatggtcaggaagtgagaacccaatgatgaaaacgatgcgtattgctgcgatcccgggagacgggattggcaaagaagtccttcctgaagggattcgcgtgttacaggctgccgctgagcgctggggcttcgccttgagttttgagcaaatggagtgggcgagctgcgagtattacagccatcacggtaaaatgatgccggacgactggcatgagcaacttagccgtttcgacgccatctattttggtgccgtcggctggccggataccgttccggaccatatttcgttgtggggttcgctgctgaaatttcgtcgtgaattcgaccagtacgtcaacctgcgcccggttcgtctctttcctggcgttccctgcccgctggcgggaaaacagcctggcgacatcgatttttacgtggtcagggaaaacaccgaaggcgaatattcctcgctcggcggtagagtgaatgaaggtacagagcatgaagtcgtcattcaggaatcggtatttacccgccgtggtgtcgatcgcattttgcgttatgccttcgaacttgcgcaaagccgtccacgtaagacactaacttctgccactaaatcgaacggtttagccatcagcatgccgtactgggatgagcgagtggaagcaatggccgagaattacccggagatccgctgggacaagcagcatattgatattctctgcgcgcgttttgtgatgcagccggaacgattcgatgtggtggtggcgtccaatttgtttggcgatatcctttccgatcttggcccggcctgcaccggcaccattggcattgccccatccgccaacctgaatccggaacgcactttcccgtcgctcttcgagcctgtccacggttccgcgccggatatctacgggaaaaatattgctaaccctatcgccacgatttgggccggggcaatgatgctcgattttctcggcaatggcgatgagcgtttccagcaagcgcataacggtattctggcagcaattgaagaagtgattgctcacgggccgaaaacacctgatatgaaaggcaatgccaccacgccacaggttgccgacgcgatttgcaaaattattttgcgttaaggtcaaaccagtttatttgaaccgcgtcactgacgcggtttttttattcgttctttgcagtaaataacctgcgtcatttcaccttttattgtttccgtttcgtgttttatggctttccgtattcttaattgtttaatttatgtaacatgcaaattttgttacgcgtacgttaggttccgccgtacaggtattggttttgctggcaatgggactggtgatttatttagccaccagtaaatacggcaatattcgtcttggcgaaggaaaaccggaatacagcacgctctcctggctgtttatgtttatttgtgccggtttaggttcttctacgctttattggggggttgctgaatgggcctattattatcaaacacctggattaaatatcgcaccgcgttcacaacaggcactcgaatttagcgttccctactctttcttccactggggcatcagcgcctgggcaacttatacgctggcctcattaatcatggcttatcactttcatgtgcggaaaaacaaaggtctgagcctttccggcattattgctgctattaccggcgttcgcccgcaaggcccatggggaaaactggtcgatttgatgttcctgatcgccactgtcggcgcactgaccatttcccttgttgttaccgcagcaacctttacccgtgggctttccgcgctgaccggtttacccgataacttcaccgtgcaggcatttgtgatcctgctttccggcggcattttttgcctaagctcgtggattggtatcaacaacggtttgcaacgtctgagcaaaatggttggctggggcgcgttcctgctgccattactggtgctgattgtcggcccaaccgaatttattaccaacagcatcatcaatgccatcggcctgaccacgcaaaacttcctgcaaatgagcttattcaccgatccgcttggcgatggttcatttacccgcaactggaccgttttctactggctgtggtggatctcatacacccctggcgtagcaatgtttgtcacccgcgtttcccgcggtcgtaagattaaagaagttatctggggactgatcctcggcagcaccgtcggttgctggttcttctttggcgtaatggaaagctatgccattcatcagtttatcaatggcgtaatcaacgtcccacaggtgctggaaacactgggcggcgaaacagctgtacagcaagttctgatgtcgttgccagccggtaaattgttcctcgccgcatacctgggcgtgatgattattttccttgcctcgcatatggatgcagtggcctacaccatggcggcgaccagtacgcgtaatctccaggaaggtgacgatcctgaccgtgggctgcgtcttttctggtgcgtggtgatcactctgatcccgctttccatcttgtttaccggtgcttcgctggaaacgatgaaaaccaccgtcgtgctcacagcccttcccttcctcgtcattttactggtgaaagtcggcgggtttattcgctggctgaaacaggattacgccgacattccggctcatcaagttgaacattatctcccgcagacaccggttgaagccctggaaaaaacgccagtgctccctgcgggaaccgtattcaaaggcgacaactgagcgccatcatcctaacgataaaggtatccctatgagcaatctgagccctgactttgtactacccgaaaatttttgcgctaacccgcaagaggcgtggaccattcctgcccgtttttataccgatcagaacgcgtttgaacacgaaaaagagaacgtcttcgccaaaagctggatttgcgtcgctcacagcagcgaactggcgaatgccaatgattatgtgacgcgtgagatcattggcgaaagcatcgtgctggtacgcggtcgtgataaggttttgcgcgcgttctataacgtgtgtccgcaccgtggtcatcagttgttgagcggtgaaggaaaagcaaaaaatgtgattacctgcccgtatcacgcatgggcattcaaactcgatggcaacctggcccatgcacgtaactgcgaaaacgtcgccaatttcgatagcgacaaagcgcaactggttccggtgcgtctggaagaatatgccggattcgtcttcatcaacatggaccccaacgccaccagcgtagaagatcaattacccggcctgggcgcgaaagtgctggaagcctgcccggaagtccacgatctgaaactggcggcccgctttaccacccgcacgcctgccaactggaagaacattgtcgataactatctcgagtgctatcactgtggtccggcgcatccaggtttctccgactccgtacaggttgatcgttactggcacaccatgcacggtaactggacgctgcaatacggtttcgccaaaccgtccgaacagtcgtttaaatttgaagagggtacggatgcggcattccacggtttctggctgtggccgtgcacgatgctgaacgtcaccccgatcaaagggatgatgacggtcatttatgaattcccggtggattctgaaactaccctgcaaaactacgatatttacttcaccaatgaagagttaaccgacgagcaaaaatcgctgattgagtggtatcgcgatgtgttccgtccggaagatttacgtctggttgaaagcgtacagaaagggctgaaatcgcgtggctatcgtggtcaggggcgcatcatggccgacagtagcggtagtggcatttccgaacatggtatcgcccatttccataatctgctggcgcaggtgtttaaggactaatgacatcggcggcggtattttccgccgctgggctgatttttgatggagtacagcaatgtcagactatcaaatgtttgaagtacaggtgagccaggttgaaccccttaccgaacaggtgaaacgcttcacgctggtggcaaccgatggcaaaccattacctgcgtttaccggaggaagtcacgtcattgtgcagatgagcgatggtgataaccagtacagcaatgcgtattcactactgagttcgccgcatgacacctcttgttatcagattgccgttcggctggaggaaaactcgcgcggcggttcccgctttttgcatcagcaggtaaaagtgggcgatcggttaacgatttcaacgcctaataacctgtttgcgctaattccctcagccagaaagcatctgtttatcgcgggcggtattggtatcacccctttcctgtcgcacatggcagagctgcaacacagcgacgtcgactggcagctacattactgctcgcgaaatccagaaagttgcgcatttcgtgatgagctagtccagcatccgcaggctgagaaagtccatttgcatcattcatcaaccggaacacgactggaattagcgcgattattggcggatatcgaacctggcacacacgtttatacctgtggccccgaggcgctaattgaagcggtaagaagtgaagctgcgcgtctggacatcgccgccgatacgctgcactttgagcaatttgctatcgaagacaaaaccggcgatgcatttaccctggtgcttgcccgttccggaaaagagtttgtggtgccggaagagatgactattttgcaggttattgaaaataataaagccgcgaaagtggaatgtttatgtcgtgaaggggtatgcggaacctgcgaaacagcaatactggaaggtgaagctgaccatcgggatcaatattttagcgatgaagagcgtgccagccagcaaagtatgttgatctgttgttcgcgtgcgaagggtaaacgcctggtgttggatttgtagtttgccgaagccggatgtggcgctgagcgcgcccagtccggcttcggaagattttactgcggatattcctgcaataaattgtgtaatgcttccgccatcagctcaccacgccagccggaaatcagctccggcaaattgttctgcggtttcagtttccagtgccagttcagcagttggttgatttgccgacgcgatgccagcaattcggcgctgatcttatgcgtttcgctcacgtcagtaatcagcgacttaatcgctttaaacgctttacgataacccggcatgtccatcaggttaagcatcggctgcggtaaggcatcttccggcaatgtctgcgctttttccaccagcgctagcagcgttttaccgtgaaagcggatttcgctaccggataaacccaggctgtccagttcgcctaaacttcccggcatataacgcgctaccgaccacaaatgctcttcacgcacgacaaagttcaccgccagatcgcgctctcgcgccttgcgcagtcgccagtcggctaacagttgcagacaggccagttggcgtgtgcgtaattgccaggcattggtgatatcacgccaggcatcttccggcgcaacgacttcctgacgacgcatttgcatcaggcggcattcatccagcgccgcaggtagccagccggaggcctccgtttctaccataagcttggcggtgatcggtaacagataccagacatccgccgctgcgtattcacactgacgttcggtcagcggtctggccagccagtcggtgcgcgattcactcttgtccagcgtaacgccggaatactcttccaccatggaagcgaaaccccatgacatcgggcgtccgcagaaggcagcaaggatttgcgtgtcaatcaagggttgtggtaattcgccaaagacattgaggaacacttccagatcttcactgcctgcatggagaaattttgtgatggacggatcgcgcaggatcgctttcagcggtgaccagtcggtgatcccgagtggatcgattagcgccagatgctcgccatcgaaaagttgaatcaaccccagctgcgggtaataagtgcgcgtacgaacaaattcagtatccagggctatcgccggaaaggcacggacggcttcacacaaagaagccagcgcatcgtccgtggtaatcatttggtaattcaaattgttttctctttagtgggcgtcaaaaaaaacgccggattaaccggcgtctgacgactgacttaacgctcaggctttattgtccactttgccgcgcgcttcgtcacgtaattctcgtcgcaaaatttttccgacgttagatttcggtaactcatcacgaaactccaccagcttcggtactttgtatcccgtgagctgacggcggcaaaaagtcaccagtgactcttcggtaagcgatggatcttttttcactacgaagattttcaccgcttcaccactggagccggaaggtacgccaacagccgcgacttcctgtacgccaggatgctgcatgacgacatcttcaatctcgttgggatagacgttaaaaccggaaaccagaatcatgtcttttttacgatcgacaatgcgcaggaatccttcttcatccattaccgcgatgtcgccggtgtgtaaccagccatttttgatgatttcatcggtagcatcgggacgctgccagtaacccagcatcacctgcggtcctttgacacaaagctcacccggttgacctggtggtacttcattatcatcatcatccaccagtttggcttccgtcgacggcaccggcaaaccgatgctaccactatgataatcaatatcatatgggttaacgctgaccagcggcgcacactcggtaaggccatagccttccagcagatactgtccggtcagtttcacccaacgctctgccaccacttgctgcactggcatcccaccgcctgcggaaagatgcagactggagaaatccagctgctggaactctttattgttcagcaacgcattgaacaaggtgttaacgcccgtgatagcggtaaacggatatttcgctaactcttttaccaaccctggaatatcgcgcgggttagtgataagcaggttctgcccacccagttcgataaacagcaggcagttaatggtcagggcaaaaatgtgatacagcggcagcgccgtcaccaccagctctttgcccggatgcaacagcggaccataggtcgcgttaacctgttccaggttcgccagcatattgcggtgagtcagcatcgcgcctttcgccacaccagtggtgccgccggtgtattgcagaaaagctaaatcttccggcaccagttcgggtttgacgtactgcatccggtagccgttatgcagtgcgctacgaaatgaaatggcatctggcagatggtatttcggcaccaaacgcttgatgtatttaacaacgaaattgactaccgtgccttttgccgtagatagctgatcgcccatacgggtcagaattacgtgctgaacggcggttttatcaaccactttttccagtgtgtgagcaaagttagacacgataacaatcgccgatgcgccgctatcgttaagctgatgctcaagctcacgcggggtatacaacgggttaacgtttacgacgatcatcccggcacgcaaaatgccaaacagcgccaccggatattgcaataaattaggcatcatcaacgcaacgcgatcgcctttcttcagccccaacccttgttgcaaataagcggcaaacgcgcgactgcgttcttccagcttgcggaaggtcattacctcccccatattcacaaacgcaggttgatcggcgtagcgcgcgaccgactgctcaaacatatctaccagagattgataacggtcagggttgatctccgtcggaacgtccgcgggataacggttaagccaaaccttcttcaattcttcacctctaaaatgcgtgttcgtcgtcatcgcaaccccaaatgatatacatgccgttaacataatattaactcatcataccagcttgataattacccaacgaaaaggttgcgaagcgcgtcactatttatttttatctttaccgtaagaatgcagaaacagcggaccagccgctgtttctttttctttaaaaacaagcaattattcagttacaactgtttgtactctcgcggggccgggattataccagccccatccgccgtagccatagggccagccacgaccgccataaaaccatggatcaatcggctgaggcggcataatcacctgctgggttaaatgccaacgtttgtaacccgttacttgcatcaccataaatttatagggcgtattgccgattttgccgtcaaccgcaccagtgattggcccgactaccgtaaccagttgtccacggaaatccaccgggtccagaaaaccgttcacatcggcataaatgcgaccgcgagaaggttctcccagcgtcggtctggctccgctgtccagcggtacggtagcaatttccaggcgagttttcccttgctggttttgtaccgcaaccactttgccaccaaagcgtgcctcctgaccaacgtacagctgcggcgcactcatcacccgaactaaatcttgttgcggcgtgggactgctgcctttaatggcgtccggcacagtgacacaaccgctcagcattagcgcaaacgtacctgccagtatgcctttgataacattcttttgaaccgccatggtgcgactcctttttttctcagggcatactcttaagattcattctttgcccggaagtttcttccatgcgacgttgttacgtaaataaaccggttcggcatgttccaccgccaccgttttaccctcagcaaacatctgacacgcaatcggcagcatatcttcagcagcaggcagtaacacttcgccatcgcgcaaaaccagcccgctctctttaccgagatccggccaagcttgccagcccgtccctaccgtcacccattcgccggaaagctgttgcattcgttcatggacgatttcgggtttgagtacggcttcggtttcttcaccgtgccagataccgttttcatcacgctgatattcggcccagtaaacttcgcccattcgcgcgtcaatggctgccagcacgcgggttgcgccgtttttgcgccacgccccttgcgccatcgtcattagcgtggagacgccaatcatcggtaattccgcgccaagcgccagcccttgcgcgatgccaataccaatgcgcacgccagtaaagctaccggggccgcgcccgtaagccagagcgttaatatcagtcagggaagttccgctggtggtcaggatatcctgcaccatcggtaagattcgttgagtatgttcacgagggcaaagctcaaaatgagcgttgacagtaccgtcgttccacagggcgacagagcaggcctctgtcgcggtatcgatagccagaattcgcatgggtcttcgtgcttagatcaataaaaaggcgcgcatcataccatactccgtaacaaattacctggaggatggtatcgcaaggaaacgaaccgcacgggcaatgtcacgggtgcgtggcgcgggcggcagactggcgagaaacgtcgcgccgtaaggacgcatcaccagccgattgtcacaaatcaccagcacgccacgatcgtcggcgtcgcgaatcagtcgccctaccccctgtttgagagtaatgacggcatctggtagttgcacttcatcgaacgggtcgccaccgcgcaaacgacaatcttccatgcgcgcttttaacagtggatcatccggcgaggtaaacggcaatttgtcgataattaccaatgacaatgtatcgccacgcacgtccaccccttcccagaaactgctggttgccacaagaagcgcattaccggcgctgacaaattgctgcaacagttgccctttgctggtttccccctgcaacaatacaggaagcgtcatggtagcgcggaactgctcggccagatcgcgcatcatggcgtgcgaggtacaaagcataaaacaacgaccgttgttagcttcgatgatcggtcgcagcattgccgctaactggcgagcagaacctggctggttggtttgcggcagattgcgcagcacacagagtaacgcctggcggctgtaatcaaatgggctgggcaacagcaacgactcggcctgttcgatgccaagccgcgaggtgaaatgatgcagatcgtcgttcaccgacagcgttgctgaggtgaagatccagctaccgggtttttgcgccattaactctttgaatttatccgccacgctgagcggcgtgagagccagagtaaaatggcgcgaagtgcattcgtaccagtagctgtagcccggctgattgatctcttttagccgcttcagccgtgtgcgatacaacgtggcgcgctcaaatgccgcatccagcaaggcggaacgccccagtgacagtttcgccacgtcataacaaagttccagggtgtcatcgagcagtaaaaatgcccgctgaatttgcggattagctaacagctcacgcaggttaccgcgataacctggctcaccgagttgcagacgaaaatcctgcgcactctgggcaagacgatcagcgcacttttgtaactgctgggtgtcttttaattcggtgcggtaggcgatggtgatgtcttttgccaggtcgagcagttgtcgactggagagtgactgaccaaaatactggctggcaatgtccggtagctggtgggcttcgtcgaagatcatgacgtccgcttccgggatcagttcgccaaatccactctctttaaccaccatatccgccagaaagagatgatggtttaccaccaccacatcggcgtccatcgcttttttacgtgctttgaccacaaagcaatctttatacatcgggcagtcgctgccaagacagttgtcgttggtgctggtgaccagcggccacgcctgtgaatcttccgccacgctgacgcaggtgctgatatcaccatcgactgtttgattagaccaggagcgcagcaggatcacatcgcttaagatttgtaccggcagatcgccccccgccagcgcctgctgttcgagacgttcgaggcagaggtagtttgagcgccctttcagcagcgccacgttgcccgtatatttcaatgcctttgagactgttggcaaatcgcggctgtagagctgatcctgcaacgcttttgagccggtcgagataatgactttctttttcgcccgcagcgcaggagccaggtaagcgtaggttttgcccgtaccggttcctgcttccaccaccagcggctggcctttttctatcgcctgggtgacggctaccgccatctgtcgctgtggttctcgcggcttaaagcctggtatcgctttcgccagctgaccgtctggtgcaaaatcgtccgtcacactaccccctgttgatttgaacagggattatgtcaggatgagggcgctttcgccagttgaagtggtgacggcgacctcacattgtggcagtctttgcagcacgaaaatggaagtataatgaggacaaaatgatgactatcgttcgtatcgatgctgaagcccgctggtctgatgtagtaatccacaacaacacgctctactacactggtgtaccggaaaacctcgacgccgatgcctttgagcaaaccgccaacacgctggcacagattgacgccgtgctggaaaaacagggcagcaataaatcgagcattctggatgccaccattttcctggccgataaaaacgacttcgcggcgatgaataaagcgtgggatgcttgggttgtcgcgggtcatgcgccggtgcgctgcacggtacaagcgggtttgatgaacccgaagtataaagttgaaattaagattgtggctgcggtgtaagctttatcgaagcaaaataagtcagacgataatttatcgataatactggtcggttttacataaatcgaccagagaataagatattactgttgatgcttctgctaattcattatttatatttataatttcaattttatctataaaactaactatataaataaacataaacatgccgttgtgttcgccctttgattagcaactctggttttctttcttagctgaacaatctggttatagcgtgcggactgaccgttaaatttctccatcttactggataacacaccatgagctgctacctttaaaacacctgaatgtcaacaggttaactcgtgccatatcgttataatccctttgatattagatgcaaattaaggtcatatatagccttatcgataacatggttaattttaaggataagaatatgcctgctgtaatagataaagccctggatttcattggtgccatggatgtatcagcgccaacaccaagttcgatgaatgaaagcacggcgaagggaatctttaaatatttaaaagaactgggagtacccgcgagtgccgctgatattacggcgcgagctgaccaggaaggctggaaccctgggttcacggaaaaaatggttggatgggcaaaaaaaatggagacaggtgaacgttctgtgattaaaaatcctgaatacttttcaacatatatgcaggaagaactaaaagcactggtctgagttaaatttatatcagcataaatgggtcaggacgcttttaatcacatataaaaagcgtcctttttctcacaatcaaatgatcatcggcttctataacgaaatcgatacggattagtgtgttactcgtcttcatcctcaaaacgcgccacgattcgctcgccggagtggttggcacgcagctcttctgccaccagcgcgattgcctggccgctgctcatcccttgtgccatcagttcctggatccgctcgacagctttttgctgctgttcatgggtgagtgaaggtaaacctgcaaacattgttaactcctgctaaattgttggcgctaattatttcatgctacccggcacatagccagtagagtcaggactgatgaagacgttatctcccgctgtgattactttactctggcgtcaggacgccgctgaattttatttctcccgcttaagccacctgccgtgggcgatgcttttacactccggctatgccgatcatccgtatagccgctttgatattgtggtcgccgagccgatttgcactttaaccactttcggtaaagaaaccgttgttagtgaaagcgaaaaacgcacaacgaccactgatgacccgctacaggtgctccagcaggtgctggatcgcgcagacattcgcccaacgcataacgaagatttgccatttcagggcggcgcactggggttgtttggctacgatctgggccgccgttttgagtcactgccagaaattgcggaacaagatatcgttctgccggatatggcagtgggtatctacgattgggcgctcattgtcgaccaccagcgtcatacagtttctttgctgagtcataatgatgtcaatgcccgtcgggcctggctggaaagccagcaattctcgccgcaggaagatttcacgctcacttccgactggcaatccaatatgacccgcgagcagtacggcgaaaaatttcgccaggtacaggaatatctgcacagcggtgattgctatcaggtgaatctcgcccaacgttttcatgcgacctattctggcgatgaatggcaggcattccttcagcttaatcaggccaaccgcgcgccatttagcgcttttttacgtcttgaacagggtgcaattttaagcctttcgccagagcggtttattctttgtgataatagtgaaatccagacccgcccgattaaaggcacgctaccacgcctgcccgatcctcaggaagatagcaaacaagcagtaaaactggcgaactcagcgaaagatcgtgccgaaaatctgatgattgtcgatttaatgcgtaatgatatcggtcgtgttgccgtagcaggttcggtaaaagtaccagagctgttcgtggtggaacccttccctgccgtgcatcatctggtcagcaccataacggcgcaactaccagaacagttacacgccagcgatctgctgcgcgcagcttttcctggtggctcaataaccggggctccgaaagtacgggctatggaaattatcgacgaactggaaccgcagcgacgcaatgcctggtgcggcagcattggctatttgagcttttgcggcaacatggataccagtattactatccgcacgctgactgccattaacggacaaattttctgctctgcgggcggtggaattgtcgccgatagccaggaagaagcggaatatcaggaaacttttgataaagttaatcgtatcctgaagcaactggagaagtaagacgtggaataccgtagcctgacgcttgatgattttttatcgcgctttcaacttttgcgcccgcaaattaaccgggaaaccctaaatcatcgtcaggctgctgtgttaatccccatcgtccgtcgaccgcaaccggggttgttgctgactcagcgttcgattcatctgcgtaaacacgctggacaagtggcattccctggaggtgcagtcgatgacacggacgcatcagctatcgccgccgcgctgcgcgaagctgaagaagaggtcgctataccgccttccgccgttgaagttatcggcgtgctgccgcccgtcgatagcgtcactggctaccaggtaaccccagtggtcggcattatcccgcccgatctgccgtatcgcgccagtgaagatgaagtctcggcggtgtttgaaatgccgctcgcccaggcattacatctgggtcgttatcaccctttagatatctaccgccgtggtgattcacatcgggtatggctgtcctggtacgaacagtattttgtatggggaatgaccgcaggcataattcgtgagctggcgctgcaaattggtgtgaaaccctgactatacttatctttacatctacaaaacactacttgagacaatcatcgcaatattagttaaatcgcggtttttgattagtttaattcatgtgaatagttaagccagtcgccgcgttccctcttacactatgcgctgttattagttcgttactggaagtccagtcaccttgtcaggagtattatcgtgattagtctattcgacatgtttaaggtggggattggtccctcatcttcccataccgtagggcctatgaaggcaggtaaacagttcgtcgatgatctggtcgaaaaaggcttactggatagcgttactcgcgttgccgtggacgtttatggttcactgtcgctgacgggtaaaggccaccacaccgatatcgccattattatgggtcttgcaggtaacgaacctgccaccgtggatatcgacagtattcccggttttattcgcgacgtagaagagcgcgaacgtctgctgctggcacagggacggcatgaagtggatttcccgcgcgacaacgggatgcgttttcataacggcaacctgccgctgcatgaaaacggtatgcaaatccacgcctataacggcgatgaagtcgtctacagcaaaacttattattccatcggcggcggttttatcgtcgatgaagaacactttggtcaggatgctgccaacgaagtaagcgtgccgtatccgttcaaatctgccaccgaactgctcgcgtactgtaatgaaaccggctattcgctgtctggtctcgctatgcagaacgaactggcgctgcacagcaagaaagagatcgacgagtatttcgcgcatgtctggcaaaccatgcaggcatgtatcgatcgcgggatgaacaccgaaggtgtactgccaggcccgctgcgcgtgccacgtcgtgcgtctgccctgcgccggatgctggtttccagcgataaactgtctaacgatccgatgaatgtcattgactgggtaaacatgtttgcgctggcagttaacgaagaaaacgccgccggtggtcgtgtggtaactgcgccaaccaacggtgcctgcggtatcgttccggcagtgctggcttactatgaccactttattgaatcggtcagcccggacatctatacccgttactttatggcagcgggcgcgattggtgcattgtataaaatgaacgcctctatttccggtgcggaagttggttgccagggcgaagtgggtgttgcctgttcaatggctgctgcgggtcttgcagaactgctgggcggtagcccggaacaggtttgcgtggcggcggaaattggcatggaacacaaccttggtttaacctgcgacccggttgcagggcaggttcaggtgccgtgcattgagcgtaatgccattgcctctgtgaaggcgattaacgccgcgcggatggctctgcgccgcaccagtgcaccgcgcgtctcgctggataaggtcatcgaaacgatgtacgaaaccggtaaggacatgaacgccaaataccgcgaaacctcacgcggtggtctggcaatcaaagtccagtgtgactaatacttcttactcgcccatctgcaacggatgggcgaatttatacccgctttctcgtctgctgtaatattccccactacacttccactgttgcgtcaggcgtttgtcgccatacgcttacagggtggcccgcatgcaaaaagcacaacggatcattaaaacctatcgtcgtaatcgaatgattgtttgtacgatttgcgcactcgttacgctcgcttcgaccctgagcgtgcgatttatttcacagcgtaacttaaatcaacaacgggtagtacaattcgccaatcacgctgtagaggaattagataaagtactgcttcccctacaggcaggtagcgaagtcttgcttccgctgattggtctgccctgctctgtcgcccatttgccattacgtaaacaggcggcaaaactccaaactgtgcgatccattggcctggtgcaagacggcacactttattgctccagcatttttggttatcgcaatgtgcccgtcgtggacattctggctgaacttcctgcaccgcaaccacttttacgcctgacgatcgaccgtgccctgattaaaggcagtccggttttgattcaatggacgcctgcagcgggcagtagcaatgctggggtcatggagatgattaacatcgacttactgacggcaatgctgcttgagccacaactgccgcaaatcagtagcgccagcctgacggtggacaaacggcatttgctctatggtaatgggctggtagattcccttccgcaacctgaagacaatgaaaactatcaggtttcttcgcaacgctttccttttaccattaacgttaatggtccgggggctacggcgctggcatggcactatcttccaacacaattaccgctggcggtgctgctaagtttactggtgggctacatcgcctggctggcgaccgcttaccgaatgagcttttcccgcgaaatcaatctgggcctggcgcaacatgagttcgaattgttctgtcagcctttgcttaatgcgcgcagccagcaatgtattggtgtagagattttgctgcgctggaacaatccgcgtcagggctggatttcaccggatgtgtttattcctatcgcggaagaacatcatttaattgtgccactgacccgctatgtgatggcagaaaccattcgtcagcgccatgttttcccgatgagtagtcagtttcatgttggcattaacgtcgcacccagccattttcgccgtggtgtgctgataaaagatctcaatcagtactggtttagcgctcacccgattcagcaactgatcctcgaaatcaccgaacgcgatgccttactggatgttgattatcggattgcccgcgagctgcatcgtaaaaacgtcaaactggcgattgatgacttcggcaccggcaacagctcgttttcctggcttgaaacattacgtcctgacgtgctgaaaattgataagtcatttaccgcagctataggttctgacgcggttaactcgacggtgaccgatatcatcatcgcgctggggcaaagactgaatattgaactggtggcggagggcgtggaaacgcaagaacaggcgaagtatttgcgccgtcatggcgtgcatattttgcaagggtatttgtacgcacagccgatgccgctacgtgattttcccaaatggctggcgggcagccaaccgccgcccgcccggcataatggacatatcacgcccattatgccgttacgttaacgcttactcatcttcatcgtgcgccggttgctctttaacaatgcgaaccagatcaacacgataatcattggcttcaatgatggtgatatgcagtggccctacatcaatcacatcgcccacacggggaatgtgaccatttgccgagatcacgaggcccgcgaccgtcgcgatatcatcgtcatcggcaaggtgctcaacatcaagcgcctgctgcaaggcatgcaaatctgtaccgccttttaccagccagccgtcaccatcagtaatgatttccggcgtttcgtcagcgtccgggaattcacccgcaatggcttccagcacatccagcggcgtgaccagaccttgtaccacaccaaactcgttggtcacgataacaaagctcccgcgagcacgacgcagcacgcccaacaggttgatcggatcgagggtttccgggacgataatcgccggagacgccgaagcaatcgccgccacatcaacgccctcttccagcgccaccagcagttctttagcacgtacaataccgatgatttcatccagttcaccgcgacataccgggaacagactgtgcggtgaagagagcagttgctcgcggatttcatcgaccccgagattagcgtcaacccagcttatttcaccgcgcggcgtcatgatcccgcgcagagaacgcgacgccagcgtcagtacgccgttaatcatgtaacgttcttcttcggcaaatgcaccttccgggatcggcatcggcatcgggttatcggcatcgtgctgaacattggcctgacgtttcccgcccatcaaacgcaggatggcatcggcagtacgcgctcgcagcggcaaagtcgactggtggcgaataaagttgcgacgcgcaatctggttaaacacttcgatgatgatcgagaagccaatcgcggcatacaggtaacctttcggaatgtggaaaccgaaaccttctgccaccagactcagaccaatcattaacaggaagctcagacagagcaccaccaccgtggggtgctggttaacgaatcgcgtcagcggtttggatgccagcaacataaccgccatcgcaatcactaccgccgccatcatcaccggcagatggttaaccatccctactgcagtaattaccgcatccaacgagaagacggcgtcaaggatgacaatctgtgtgacgaccacccagaaactggcgtagcctttaccgtggccggaatcatgatcgcggttttccagccgttcatgcagttcggttgttgctttgaacagcaagaatatccccccgaacaacataatcaggtcgcgtccggagaaggagaaatccatgacggtaaatagcggtttggtcagcgtgaccatccatgaaatcagcgacagcagccccagacgcataatcagcgccagtgataaccccagcaaacgcgctttatcgcgttgttttggcggcagtttgtcagcaagaatggcgatgaagaccaggttatcgatacccagcacaatttcgagaacaacaagcgtgagtagccccgcccaaattgaggggtccattaagaattccatgacaagctcctgcttaaggaatagctattcgacgccagaaataatgcaggcgtaacgacaaaatgcaaacgaaaggtgcggcatagagtgccagaaaggcaggcgttaaaaggcctgatgctgaaatgacgtcggtgacgatccatactgcgggctactgccctatactccatggttgttaaacgggagttaaacatatcagagacgcctctgatttggcaaagatttaccttcctttgcaaacgaatgtgacaaggatattttacctttcgaaatttctgctaatcgaaagttaaattacggatcttcatcacataaaataattttttcgatatctaaaataaatcgcgaaacgcaggggtttttggttgtagcccttatctgaatcgattcgattgtggacgacgattcaaaaatacatctggcacgttgaggtgttaacgataataaaggaggtagcaagtgaccattgctattgttataggcacacatggttgggctgcagagcagttgcttaaaacggcagaaatgctgttaggcgagcaggaaaacgtcggctggatcgatttcgttccaggtgaaaatgccgaaacgctgattgaaaagtacaacgctcagttggcaaaactcgacaccactaaaggcgtgctgtttctcgttgatacatggggaggcagcccgttcaatgctgccagccgcattgtcgtcgacaaagagcattatgaagtcattgcaggcgttaacattccaatgctcgtggaaacgttaatggcccgtgatgatgacccaagctttgatgaactggtggcactggcagtagaaacaggccgtgaaggcgtgaaagcactgaaagccaaaccggttgaaaaagccgcgccagcacccgctgccgcagcaccaaaagcggctccaactccggcaaaaccaatggggccaaacgactacatggttattggccttgcgcgtatcgacgaccgtctgattcacggtcaggtcgccacccgctggaccaaagaaaccaatgtctcccgtattattgttgttagtgatgaagtggctgcggataccgttcgtaagacactgctcacccaggttgcacctccgggcgtaacagcacacgtagttgatgttgccaaaatgattcgcgtctacaacaacccgaaatatgctggcgaacgcgtaatgctgttatttaccaacccaacagatgtagagcgtctcgttgaaggcggcgtgaaaatcacctctgttaacgtcggtggtatggcattccgtcagggtaaaacccaggtgaataacgcggtttcggttgatgaaaaagatatcgaggcgttcaagaaactgaatgcgcgcggtattgagctggaagtccgtaaggtttccaccgatccgaaactgaaaatgatggatctgatcagcaaaatcgataagtaacgtattgtgttgattatcactcagttttcacacttaagtcttacgtaaacaggagaagtacaatggagattaccactcttcaaattgtgctggtatttatcgtagcctgtatcgcaggtatgggatcaatcctcgatgaatttcagtttcaccgtccgctaatcgcgtgtaccctggtgggtatcgttcttggggatatgaaaaccggtattattatcggtggtacgctggaaatgatcgcgctgggctggatgaacatcggtgctgcagttgcgcctgacgccgctctggcttctatcatttctaccattctggttatcgcaggtcatcagagcattggtgcaggtatcgcactggcaatccctctggccgctgcgggccaggtactgaccatcatcgttcgtactattaccgttgctttccagcacgctgcggataaggctgctgataacggcaacctgacagcgatttcctggatccacgtttcttctctgttcctgcaagcaatgcgtgtggctattccggccgtcatcgttgcgctgtctgttggtaccagcgaagtacagaacatgctgaatgcgattccggaagtggtgaccaatggtctgaatatcgccggtggcatgatcgtggtggttggttatgcgatggttatcaacatgatgcgtgctggctacctgatgccgttcttctacctcggcttcgtaaccgcagcattcaccaactttaacctggttgctctgggtgtgattggtactgttatggcagtgctctacatccaacttagcccgaaatacaaccgcgtagccggtgcgcctgctcaggcagctggtaacaacgatctcgataacgaactggactaacaggtgagcgaaatggttgatacaactcaaactaccaccgagaaaaaactcactcaaagtgatattcgtggcgtcttcctgcgttctaacctcttccagggttcatggaacttcgaacgtatgcaggcactgggtttctgcttctctatggtaccggcaattcgtcgcctctaccctgagaacaacgaagctcgtaaacaagctattcgccgtcacctggagttctttaacacccagccgttcgtggctgcgccgattctcggcgtaaccctggcgctggaagaacagcgtgctaatggcgcagagatcgacgacggtgctatcaacggtatcaaagtcggtttgatggggccactggctggtgtaggcgacccgatcttctggggaaccgtacgtccggtatttgcagcactgggtgccggtatcgcgatgagcggcagcctgttaggtccgctgctgttcttcatcctgtttaacctggtgcgtctggcaacccgttactacggcgtagcgtatggttactccaaaggtatcgatatcgttaaagatatgggtggtggcttcctgcaaaaactgacggaaggggcgtctatcctcggcctgtttgtcatgggggcattggttaacaagtggacacatgtcaacatcccgctggttgtctctcgcattactgaccagacgggcaaagaacacgttactactgtccagactattctggaccagttaatgccaggcctggtaccactgctgctgacctttgcttgtatgtggctactgcgcaaaaaagttaacccgctgtggatcatcgttggcttcttcgtcatcggtatcgctggttacgcttgcggcctgctgggactgtaagactgttgtacactaccggggccttttggccccgtttttttatctggaggattaatgacaatcacggacctggtactgattcttttcatcgccgcactcctggccttcgcgatctacgatcagttcatcatgccccgccgtaacggccccaccctgctggcaattcctttgctccggcgtggtcgcatcgatagcgttatcttcgtcggattgattgtcattcttatctataacaacgtcacgaatcatggtgcgttaataacgacatggttattaagcgcactggctctgatgggtttttatatattctggatccgcgttccgaagatcatctttaaacaaaaaggttttttcttcgccaatgtctggattgaatatagccgaatcaaagcgatgaacttgtcggaagatggcgtgttggtgatgcaattagaacagcgtcggctgttaatccgcgttcgaaatatcgacgatctggaaaaaatttataagcttctcgtttcaactcaataagttatgaatttagccaaagctatgtttagtgtatttttaataatcagacatagcttaggctatattacctcttcccttatttgttatttattttaacgtttcattgatatataaatccaaatgaaaatcgttatcaataaagcaatgaaataatatattccaacagttgttttatattctcaaaatatgttaaggttgcgccctcatttggggagtagccgatttccagattccggaaatgtacgtgtcaacatactcgttgcaaaacgtggcacgtacggactgaatactttcagtcaggcgagaccatatgcacatcaatcgctatgcctgcatgaacgcgaaaaccatcacggcttgttgttcatgtatgcatgtttgctgggggcgatgatgtgttttatggataccccggtcaggacattgtcatgaatatcactgctactgttcttcttgcgtttggtatgtcgatggatgcatttgctgcatcaatcggtaaaggtgccaccctccataaaccgaaattttctgaagcattgcgaaccggccttatttttggtgccgtcgaaaccctgacgccgctgatcggctggggaatgggcatgttagccagccggtttgtccttgaatggaaccactggattgcgtttgtgctgctgatattcctcggcgggcgaatgattattgagggttttcgtggcgcagatgatgaagatgaagagccgcgccgtcgacacggtttctggctactggtaaccaccgcgattgccaccagcctggatgccatggctgtgggtgttggtcttgctttcctgcaggtcaacattatcgcgaccgcattggccattggttgtgcaaccttgattatgtcaacattagggatgatggttggtcgctttatcggctcaattattgggaaaaaagcggaaattctcggcgggctggtgctgatcggcatcggcgtccagatcctctggacgcacttccacggttaataagaacgctgccagaggtgaatattaaagtccgtctggcagtcgaacacttcttttgctgccagtgtttgccagacttctggcttcgcacgccaggcaaacggcgtcatctgcaataatgcgacggcttcatcaccgcgaagacgcatcggataacacaactccgcactctgctgtaatgtaaaaccttccagttgttctgcatgaggtgcatgaagatgtacttcattgtaaatcagccccttcagctccatcaaatgtcgcggtcccggcgtggcagtaatgacccagccgccgggcttcactactcgtgctaattcttctgctttacacggcgcgtaaatacgtattatggcgtccatactggtatcggaaaacggcaaacggtggctggaagcgacacaaaaagtgacctgcggatagcgtttcgccgccgcttttatcgctaccttcgaaacatccagaccaaacgtggtgatttcgggcaacgcatcggcaaatgcgtgtgtgtaatacccttcaccacagccaatatccagcaccgccgtggccttatcatcaagccgttccctcagttgggcgacaattgcatcacgcagcggctgataatgtccggcatctaagaatgcgcggcgtgcttgcatcatttccgcgctgtcgcccggatcacgagaccgtttatgctgaacgggcagcagattgacatacccttctttcgccatatcaaactgatgtcgctggggacagatatagctgtttttttcacgcgaaagaggctgatggcaaagtggacaggaaaaagacatgacaactccggcaggatactaaaggccgcaagtgtaacgcgaatcacgcggcgggcaaatatccgaacgccaggagcgaagataaagcatagtaaaaagcctcgcattcgacgaggctttatagcgagattgaagcgtattcacacttcagatcagtggattcgatcagatagctgttacgttaacagctgccggacctttctggccgtcctgaatttcgaactcaacgttctgaccttcagccagagttttgaagccattaccctggatagcggagaagtgtacgaacacatctttgctgccatcagccggagtaatgaagccaaaacctttagactcgttgaaccacttaacctgacctttaatctttgccatttgaaaaattccttagattgttttcttcgcccgcaggcataacatagataaaactgacacattactgcatgaggcaccaatataaggctcggcagagaagcggtattcaacgtcaacgtgtttactcaggacttctttactgaaaatgccacacataaacagaactgtacctcgtttaacccgaaatctgttatcacatacaacgttaattatggcaagccatttttaaacatgtctcgatcagacgcacaaatctcgatacgtcttccactttttttgcacacttatgcaacggaatacgcgccgatatatcattgtgcttaaccttgccagttcaggcagatacttaaactggcgtattttctaacatagttcaataagttcagttgttccaggccagtgggagaagttattacatagtgcgtgcaatatcacattttttgctatgcaatgaataaaaagttatatcactttttctcataaaacagtcagttaacggctattaattaccctaaagagaagtcaatccccaaagggattgtaaatttaaaataagaaaaattgatgaatgagcaaaaaaatcaagagagaaacgtttcgctaataaataataccacgcttaatcacaaatccgatgtaaacatcctaataaattaatggggtaaatatctttttctgatatcccgttacgcaaataaataatatgataattatttgaagtcagaccagagttttaatttgaagcagttgcaccatgacagtgcgtataatcaggatgaattgagtaacccttcaacgacggggttactcaagattgaggaaggattatcgttcggcgaccagacgaataatatcttcgtcttcaaccgatttttgactctcaacggtctttttatctgctttctctggttcgtttgcttcgcacaaacgacgtaacagtgcattttgacgtttttgctgatccagcaacgcctcaagcagttcaatctgttcgttagtccgtgaactggcacgattgataaaaaaccacaagatgagcccgataagaagaaccaccaccgatacaaccaaagacgcaatgttcatcacgcctgaatttacaacttcgttcatttcaccacctctgagtagaggcgctattctaccactgctggagaggaagaaaatctagtgctgaaaaaatgatatcaccacgggataaactggttaatggcacaaattccgctgaaaaattgtacatcctgatcgcacatcatgttgaatacctgcgcccaaagcagcaagcaagccaacaccacgacaaccagaacgacccatcgaaactttttcactccaatctccgtttcacctaccttatgtcattaaactagcatgcgttagttaaacagcgcctaactatgtcgatattcgtgctttttcggaatgagtcgcttgcttcagcgcatattgccgctacgattaagcgaacataaaaagagaagaggttgtaatgcgattcatcattcgcacagttatgctgatagcactggtatggataggattattactcagcggatatggcgttttgattggaagcaaagagaatgccgcaggattaggtttgcaatgtacctatctgactgccagaggcaccagcacggtacaatacttgcacactaaaagtggttttttggggataacagattgcccgctgttacgcaaaagcaatatcgtggtcgataatggttaagggcaataaataaccagattctcactcctgagtaaaatactcttatagcaagcgcgtttaatataacgccaccttcaactttatttttctcatgctaaataaagaacctgtctgtttgatattccgacaggttcttactctcatcagaacggatagtcgtgataacccatttgggcagaaattttgcgcgctgcggtatgcaacattgcgacatattcctgtaaacgctcttcagagaaacgcaacgtcgggaaggagatgctcaaaccggcaatgaccacgccaaagcgatcaaataccggtaccgcaatgcatcgcagcccttcttcctgctcttcattatcttcgccatacccctgctcgcgcacctggtccagaacgggtaataacgcttctgtactggtgatggtccgctcggtactgcgtttatactccacgccctcaagaatttgcttcacttcatcgcgatcgcgccatgccagcagtaccttaccaatcgcggtgctgtacagcggattacgacgcccaatccgtgaatacatgcgcaaattgtacatagagtcaattttgtgaatgtaaacaatactgtcttcgtccagtgcgccgaggtggatagtttctttggtcaggcgggagagctcacgcatctggatatctgcgctacgaattaaatcgacgttttgtaacgcgcgagcgcccagttcaaacaatttcagggtcagggaatatttctccgactccccttcctgcgccacataacctaaggttttcatggtctgtaaaaagcgataaacggtgctttttgacatcatgacgcgctgcgacagctcggttatccctatttcgcgctcttcacccagcgcctgcaaaatgccaaaaacttttagcacggaagatacagaatcaggctgtttatccagatctgcgttagccatttatcacctcattgcgagtgttttataaaaatcagaactgttttttattataatttcgcaccagggtggtcgcaatccatcttttgccggttagttacaattctgcgacatccaccgtgaatatcagtgctagaatcatacccctgttgattattcaccaaagatataaaattcctatgccaaaagttcaggccgacggcctgccattgccccagcgatacggtgcgatattaaccattgtgattggtatttcgatggccgtccttgacggcgcaatcgccaacgtcgccctgccaacaatcgccacggaccttcatgccacgccagccagttccatctgggtagtgaacgcctatcaaatcgccattgtcatctccctgctctcgttttcgtttctgggcgatatgtttggctatcgacgtatttataaatgcggtctggtcgtttttctgttgtcttcactgttctgcgccctttctgattcgctgcaaatgctcacccttgcgcgtgtcatacaaggtttcggcggtgcagcgttgatgagcgttaataccgcacttatccgcctgatctatccacaacgttttctgggtagagggatgggcataaactcgtttattgttgccgtctcttctgctgccgggccgacaattgctgcagcaatcctctccatcgcatcctggaaatggttatttttaatcaacgtaccgttaggtattatcgccctgcttctggcgatgcgttttctgccacccaatggttctcgcgccagtaaaccccgtttcgacctgcccagcgccgtgatgaacgcgttaaccttcggcctgcttatcactgcgttgagtggtttcgctcaggggcaatcgctgacgttaattgctgcggaactggtggtaatggttgttgttggtattttctttattcgccgccagctttctcttcccgtaccgctgctaccggtggatttactgcgtatcccgctgttttcactttctatttgcacatctgtttgctctttctgcgcacaaatgctggcaatggtttccctgcccttttacctgcaaaccgtgctcgggcgtagtgaagtcgaaacaggtttacttctgacaccgtggccgttagcaacgatggtgatggctccgctggcaggctatttgattgaacgcgtacatgcaggattgctgggggctttagggttgttcatcatggctgcggggcttttttccctggttctgctgcccgcgtcacctgcggatatcaatattatctggccgatgatcttatgtggtgctggatttggcttattccagtcacccaataaccacaccattattacctccgcgcctcgcgaacgtagcggtggagccagtggcatgttaggaacggctcgtctactgggtcagagtagcggcgcggcgctggtggcgctgatgctaaatcagtttggagataatggtacacacgtctcgctgatggctgcggctattctggcagtgattgctgcctgtgtcagtggtttacgtatcactcagccacgatccagggcataaaaaaagcgcgtcgatcaggacgcgctttttagtatttacttcatattacttcaggtattcacccgtacgcagagcttcaattcgtttatccagcggcgggtgggtcatgaacaactcactgagcgatttcgacttaccgttaatgcagagagccatcatgctggttgcttcttgcggttcatagctggttttcaggcgctgcagcgcggcaatcattttctcgcgaccaaccagttttgccgaaccggcatcagcatggaattcacgatgacgcgagaaccacatggtgataatgctcgccagaataccaaacaccagttccagaaccgttgcaaccgcaaagtagatcagcgggttgccgttgctctcttcaccttcatcacgatttccgcccataaaacccgcggcaagctgcgccagaatacgggaaataaagataacgaaggtgttcaccacgccctgaatcagcgtcatggtgaccatatcaccattggcgatgtggctgatttcgtgagcaattaccgcctcggcttcatccgggctcatgttctgcagcaaaccggtgctgacagcaaccagagaggcatcacggcgcgcaccggttgcaaaagcgttgatgtccggcgcatggtagatagccacttgcggcatagcgatccccgcctgacgagcctgggttgctacagtattgaccagccaacgttccctttcgttacgcggttgctcgatcacttccccgccaacagatcgtaatgccatccatttggacatcagaagcgaaacgaaggaaccaccaaaaccgaacagcaaggccatgatcatcagcccctgaacgctgctcgactgtatccctgtcaggctcagtaccagcccgaaaacgaccattacggccaggttcgttagcaggaagagcgcgattcgcatcataattttctttttacctcagtttaacaaaacgcaatatgcgatacccacatcgtatgggttacgcgactattttcaagtctggatagtgcgtaagtcaccagaaagacacaactttacattttgtagcatctgatttacggcatcttgtcgctgttaaaaaatcaggcacaatttcttgtgcctgattgatattacttgacgggagcgggttgttccgcgggtctggctttttcaagcttcgccagatcgagtgcgatattcaccgtctcatccagataaggatccggctcctggtaatctttcggtagatcatccagtttcttcaactccggtttaccttcgcgtttaaagcgttcgttcaaacgcgccagacgcgtcgcatcatcttcattattctctttctcacgcacagcgtaattcagagaaacgatattgcgcttgtccttcatagcgttgaagcgcgcgatatccttcatgatgttctggaactcaggatctttcgcgatacgcgcattatgttccttcagcagctccggttcaaaggccgttaaatctcctgatttcacataagtcgcggcatcaatgctatcccacggcagcgcgttatcttcgaatttctcacccgtttccgtttcttcattacccgtcggcatgatgatgtctggcgttacgcctttacgttgcgtactgccgccgttaacgcgatagaatttctggatcgtgtactgcacagaacccagcgctggccattcaggacgtaacatctgatcgtaaatacggttcaatgaacggtattgctgaacggtgcctttaccaaacgtcggttcacccacaaccagcgcacgaccgtaatcctgcattgccgcggcaaagatttctgaagccgaagcactgaagcggtcaaccagcaccaccagcgggcctttatagaaaacctgtccgtcggtatcgctatcttcacgaaccttgccgttgttatcgcggacctgaacaatgggacccgcaggaataaacagaccggagagcgatacggcttcagttaacgccccaccgccattgctacgcaggtcgatgatgacgctgctgacattctgtttttccagtttctgcagttgcactttgacatcgtctgtcaaacccacatagaagcccggaatatccagcacgccgactttctctttaccgacggtcttcaccgacattttaaccgcgcggtcttcgagacgaatacgttcacgggtcaacgttacagtacgggtcttggtccctttaccagcaggtaaaatttccagacgaactttactgcccttcggccctttaattaaggcaaccacatcatcaagacgccagccaatcacgtcaaccatcggcttgcctgtttgaccaacaccgacaattttgtcaccaacgctgatagctttactcttcgctgccggaccacctgccaccatcgaattgataacggtgtagtcatcatccatttgcagcactgcgccaataccttccagcgacaaactcatttcagtgttgaactgttcggtattacgcggggaaagatagttggtatgcgggtcgatttcacgcgcaaacgccgtcattgccagcgagaaaacatcttcgctgttggtttgcgccagacgacgaatggcaaatttgtagcggcgagtcagggtttcacgaatttctttatccgtttttcctgtcagcttcaggcttaactcgtcgaatttgactttactgtcccacagcgcgttcaactcagcctcgtttttcggccagggcgctttgctgcggtcaaggttataagtgtcgttgccggtgaaatccatcggcttttccagtaccgacaaagcgtactggtaacgctcaaaacggcgcttttgcgccagattgtagagatcgtagaaaacgtcgagtttgcctgaacgcagttcatcgcctaactcggttttctttttcgcgaactgttcaacatcgcttgccagcagcacgttgtggctgtaatcgagcagattcaggtagcggtcaaagattttggccgaaaatgcctgatcgaggtcgaactggcgataatgagaacgggtgaagcgcgacgttacgcgctcacttaccgtcgcatgctgcgtctcttcctttaataccggaatttgatcagcacgcgtgatatcttctacagcgaaggtctggcctgctattgcaagcaggccagctaacgcggtaagcctaaaaaacatgttcatgcctggcccggcctccgtttcagaacaccaggtgttctgcgcgcacaatcaaagacatacccgaattcagctggacgcggacgccgtctttggtgatttctaatacggtggcatccatcgcgttttgacccgctttcaccttcagggcttgtccgacagtcagagctgaaatgtcagaaaccggggtgtgctgttcttcgcgaggtgcttttactgtttttggcgctttctctaccggcttttgcgcacgaggtttacgttcagcgccttctttgcggcgtggcgtagtcggacgtggcttgcgttcgcggcgcggtgcgtcttctttctcaccagcagttgcggcagcttcgcgttttttcgcttgctgttcagcacgctgtgcctgaacacgcgctttcgcttcttcaagctgcttgcgagcatgctctacatgttgctcgtccagctcaccgcatgggttgccgtcaagatcgacacgcgttgcgccgggtttaacaccgtaaagataacgccagctcgaagtgtagagacgtaaagcggatcgcaattgcgttttgctcaggttcatttccccagcaacacgatcgaccaaatcctgaaaaataccgattttcagcggacgcgcttcaccttccgcactgaaacagtggggaaaacgttcggccagaaacgcgattacttctttactgctattcaacttaggttgattttccatgaaatttcctgattacaacggacgtagccaacaagcgcaggcatgaacaggcgtcattataatgacgctatcagtaaatgctacgttatccgttgattatcctgcgacgctcgcaaagaattttttgtaatccgtcgttgcaagcactttttcaagctgtgccacaagctgacgtaagccttgctcgtcctcgtctgtaaagcgaccgaagacggtactatcgatgtcgagaacaccaataatctgatttttcaccaccagcggcagaacaatttcagaattactcgccgcatcacaggcaatatgcccgtcaaacacatgaacatcctcgatacgctgcacttgattgcgggcaaccgcagtgccgcacacgccgcgcccgacgggtatccggacacaggcaattttgccctgaaatggtccgagtaccagtgtatcgtcctcaagcaaataaaaacctgcccagtttatgtcagtgagacgctcatataacaacgcactggtgttcgcaagcgttgccagaaaactggtttctcccgccatcagcgcgttaaagtcgcgatttaaatccgcgtaaaattctgttttgttcattatataatcacttggttgtcttacctggatctgccagcctattaaaataagcattaaatgcgttaatgctcaagatcattcccatcatgggttaagattaatgttaattcttattacatttggcacgtcatggctcttaacacaccacaaattacgccgacaaaaaagataacagtgagggcaatcggcgaggaactgccgcgtggtgattaccaacgttgcccgcaatgtgacatgctgtttagcctgcccgagataaattctcatcaaagtgcctattgtccgcgctgtcaggcaaaaattcgtgacgggcgcgactggtcgctaacgcgcctggcggcaatggccttcaccatgctgttgcttatgccgtttgcctggggcgaaccgctgttgcatatctggctgttaggcattcgtattgacgccaacgttatgcaaggcatctggcaaatgaccaaacagggcgatgcgataacggggtcgatggtctttttctgcgttattggtgccccgctcattctggtgacctccatagcttatttatggtttggtaaccgactgggaatgaatttacgtccggtactgctgatgcttgagcgacttaaagagtgggtaatgctcgatatctacctggtcggcattggcgttgcttctataaaggtacaggattatgcccatatccaggctggtgtcggcttgttctcttttgtggcgttggtgattttaacgacggtgacgttgtcacatcttaatgtcgaagaactgtgggagcgattttatccgcagcgccccgctacgcgtagggacgagaaacttcgtgtctgtcttgggtgccattttaccggctatccagatcagcgtggtcgctgcccgcgttgccatatcccgctacgcctgcgtcgccgtcatagtctgcaaaaatgctgggcggcgctgttagcgtcaatcgttttattgttacctgccaacctgttgcctatttctatcatttatctgaacggaggacggcaggaagatacaattctttccggaattatgtcgctggcaagtagcaacattgcggttgcaggaatcgtgtttatcgccagtattctggtaccgtttactaaagtgatcgtcatgttcactttactgttgagcattcattttaaatgccagcaaggtttacgcacacgcattctgttactgcggatggtgacctggattggtcgctggtcgatgctcgacctgtttgtcatatctttaaccatgtcgctgattaatcgcgatcagatcctcgcttttactatgggaccggctgcgttttatttcggcgcagcggtaattttgactattcttgctgtggaatggctggacagccgcttactttgggatgcacatgagtcaggaaacgcccgcttcgacgactgaagcgcagattaaaaataaacgccgtatctcacctttctggctgctgccgttcatcgcgctaatgattgccagttggctgatttgggacagttatcaggaccggggtaataccgtcaccatcgactttatgtcggcggatggtattgttccaggccgtacgcctgttcgttatcagggcgttgaagtcggaacagtgcaggatatcagcctcagcgacgatcttcgtaagattgaagtcaaggtcagcatcaagtccgatatgaaagatgcgctgcgcgaagagactcagttctggctggtgacgccaaaagcatcgttggcaggtgtctccgggctggacgccctcgtcggtgggaactatatcggcatgatgccgggtaaaggtaaagagcaggatcactttgtcgcactcgatacccaaccgaaatatcggctggacaatggcgatctgatgatccacctgcaagcccccgatctcggttcgctgaacagcggttcattggtctatttccgcaagatcccggtgggaaaagtctacgactatgccatcaatcccaacaagcaaggcgtggtgattgatgtcctgatcgagcggcgttttaccgatctggtgaaaaaaggtagccgtttctggaacgtttccggcgttgatgccaacgtcagtatcagtggcgcgaaggtgaaactggaaagcctggcggcactggttaacggtgcgattgccttcgattcaccagaagagtcgaaacctgccgaggcggaagatacctttggtctgtatgaagatctggcccacagccagcgtggcgtaataataaaactggaactgccgagtggggccggattaaccgccgactcgacgccgttaatgtatcaggggctggaagtcggacagctgactaaactggatttaaatcctggtggtaaagtcacaggggaaatgaccgttgatcccagcgtcgttaccctgcttcgtgaaaatacccgcatcgaattacgcaacccgaaattatcccttagcgatgctaatctcagcgccctgctgaccggcaaaaccttcgagctggtgcccggcgatggcgagccacgcaaagagttcgttgttgtgccaggcgaaaaagcactgctgcatgaacctgatgttctgacgctgaccctgaccgcgccggaaagttacggtattgatgcgggtcagccgctcattcttcacggcgtgcaggtaggccaggttatcgatcgtaaactcaccagcaaaggcgtcacctttaccgtcgccatcgagcctcagcatcgcgaactggtaaaaggcgatagcaaatttgtcgtcaacagccgtgtcgatgtgaaggtggggctggatggcgttgagtttctcggtgccagcgcctcagaatggatcaatggcgggatacgtattctgccgggcgataaaggtgagatgaaagccagctatccactgtatgccaatttggaaaaagcgctggagaacagccttagcgatttacccaccacaaccgtgagtttgagtgcagagacgctgccggatgtgcaggcaggatcggtagtgctgtaccgtaaatttgaagttggtgaagtgattaccgtgcgtccgcgagctaacgcgtttgatatcgatctgcatattaagccggagtatcgcaaccttctgaccagcaatagcgtgttctgggcagaaggcggggcgaaagttcagctgaatggtagtggtctgaccgtacaggcatccccgctctccagagcattaaagggagccattagcttcgacaacctcagcggtgccagcgccagtcagcgtaaaggcgataagcgtattctgtatgcttccgaaacagcggcccgtgcggttggcgggcagattacgcttcacgctttcgatgccggaaaactggcggtcgggatgccaattcgctatctcggtattgatatcgggcaaatccagacgctggatctgattaccgcacgcaatgaagtacaggcaaaggcggtactttacccggaatatgtccagacctttgctcgcggtggtacgcgcttctcagtggtcacaccgcaaatttcggcagctggcgttgagcatcttgatactatcctccagccgtatatcaacgtcgaaccaggccggggcaatcctcgccgcgactttgaattacaagaggccaccattactgattcgcgttacctggatggcttaagcattattgttgaagcgccggaagccggttcgttaggcatcggtacgcctgtgctgttccgtggtctggaagtcggtacggttacaggaatgacgctggggacattgtcagatcgcgtgatgattgcgatgcgcatcagtaaacgctatcaacacctggtgcgtaacaattccgtcttctggttggcatcgggttacagtctggactttggtctgacgggcggcgtagtgaaaaccggcacctttaaccagtttatccgtggcggcatcgccttcgccacgcctccgggtacgccactggcaccgaaagcccaggaaggcaaacacttcctgttgcaggaaagtgaaccgaaagagtggcgtgaatggggaactgcgcttcccaaataatgcccactgctccggcgtgcctgcgccggagcgtttatgctaaactgcgcgcctgtttttttgccagtggtacatgctcgtggcccaacacaccgtttatttcccggacgcctttctgacacaaatgcgcgaagcgatgccttcgacgctctcatttgatgattttcttgccgcctgtcagcgcccgttgcgccgcagcattcgcgttaatacgctgaaaatctccgttgctgatttcctgcaattaaccgctccttatggctggacgcttacgccaattccgtggtgtgaagaaggtttctggattgaacgcgacaatgaagatgcattgccattgggtagtaccgccgagcatttaagtggcctgttttatattcaggaagccagttcaatgttgcctgttgccgccttgtttgctgacggtaatgcaccacagcgggtgatggatgtcgctgccgcgcctggctccaaaacgacgcaaatttccgcgcggatgaataacgaaggggcaatccttgccaatgagttttccgccagtcgggtaaaagtgttacatgccaatatcagccgctgtggtatcagtaatgttgcgctcacacattttgatggccgcgtgtttggtgcggcagtgccagaaatgttcgatgccattttgctggacgctccctgctctggcgaaggcgtggtgcgtaaagatcccgatgcgctaaaaaactggtcaccagaaagcaatcaggaaatcgcagctacacaacgggagcttatcgacagcgcctttcatgcattacgtcctggtggtacgctggtttactcgacctgtaccttaaaccaggaagaaaacgaagccgtttgcctgtggctgaaagagacttaccccgacgcagtagagtttttaccacttggcgatctcttccctggtgcaaacaaagcgctgaccgaagaaggctttttgcatgttttcccacaaatttacgactgcgaaggcttcttcgttgctcgtctgcgtaaaactcaggcgattcccgccttacccgcccccaaatacaaagtcggtaattttccgttcagcccggtgaaagatcgcgaagctggacaaattcgtcaggcggctacaggtgttggcttaaactgggatgaaaacctgcgcctctggcagcgtgacaaagaactgtggttgttcccggtgggcattgaagccctgatcggtaaagtccgattttctcggttggggattaaacttgccgagacgcacaacaaaggttatcgctggcagcatgaagcggttattgctcttgcctcacccgataatatgaatgcattcgagctgacaccgcaggaagcggaggagtggtatcgcgggcgcgatgtttacccgcaagccgcgccagtggcggatgatgtattggttactttccagcatcaaccgattggtttagccaaacggattggttcgcgattgaaaaacagctatccgcgtgaactggtgcgcgatgggaaactttttaccggtaacgcctgacagcgcacaaaaaaagcgcactttttgactggcacattcggctgcctcaactaggctgaaaaatggtgcgatcggactggtcgtaccacaatcggcagctaaatggagagcacgaagatgaaaaccagtgtgcgcataggcgcttttgaaatcgacgacggcgaattacacggtgaatcgccaggtgatcgaacgttaaccattccttgtaaatctgaccccgatttatgtatgcaactggatgcctgggatgctgaaaccagtatccctgccctgctaaatggcgaacactctgtcctttaccgtacccgttacgatcaacaatctgatgcctggattatgcgtcttgcctgatccaaaaagaacccgtcggcatggcgggttatttgtcctggttattcccccgttgtaaaatctctcctaaacttaacggtacggcaccacacttcggggatgaaatgttcgcgctggtactttttgtttgctacctggatggcggttgtgaagatattgttgtggatgtctacaacacggaacagcagtgtctttattctatgagcgatcaacggatccgccagggcggttgttttccgattgaggattttatagatggtttctggcgacctgcacaggagtacggtgatttttaattattgcaattgcacaagagtcagttcgcccccaaagacagcaccggtatcaatataatgcaggttgccaatatccacgcgatgtcgcaacggtgtatgaccaaaccagaaatgatcagcacctgtaattccctgccctttttggcgttcacctaatcgcgagcggctccacaagacctgatgcaaatcaacgtccttttgccattcataaacatcatctggataatcggcatgagcaataacatgcttgccggtgcgactgtgtacttcaagaataaagggcaaatgctgacatttttccagcgccgttttcgcttgtttctgttgattatctgccagcgcaataaaccagtcgccgccattcatcaaccacaaagacatctgctgggatgccagcgcatccatcgccatctgttcatgattgcctcttaccgcacaaacccaatgttgttccagtaactgcagacaacgtaaactttgcggcccacgatcgataacgtctcccactgagataagtaaatctcgccacggatcaaaacgacaatgccataatttgcggcgcaactgctcaagacaaccgtgtatatcgccagaaagccagatatgtcgccattgatgacccgcaattctctgataaacgggcgcaggctgtttcatcaatattttcctcccgcgctaaagatcacataatcttaacaagaatgttaaaaaacgctggactcagacagtagagtgtgtgttatggttgactataaagtcagcgaaggaaatgcttctggcttttaacagataaaaagagaccgaacacgattcctgtattcggtccagggaaatggctcttgggagagagccgtgcgctaaaagttggcattaatgcaggcttagttgccttgccctttaagaatagatgacgacgccaggttttccagtttgcgtgcaaaatggtcaataaaaagcgtggtggtcatcagctgaaatgttaaaaaccgcccgttctggtgaaagaactgaggcggtttttttattggaaatcaaaaggctattttaggtaattaacagagtttttcagctcgttctataaacggtgccagactcattttttcgccgggattgttaggatcatcaatctgaatcaccgaaatgggttgggcattggtcttcccactggcaacttccttttgtgcgatatcgtttaaaggatactgcacgagggtactcggattaataacatacaaagcattacccggtcggcaagtcagcatcacctcttcgcgattaaacgcccatttgtctttacccacttcaaaacgactgacggtaatcacctgcggtgcagccagcgccgctgcagaactggtgagtaacagaaacgccagaatactttttttcatcattttcgtaatccatcaaaaaggttcgagagtcgcaagcaggctgatgatcaccagcactaccgcacctatcgcccattcgagtttagtcatccacacaaaccagggtgccgcacgatcttcatcctgcctcatgcgcggtacaagaacataacgattagccagcgcaatgaccaccataatcatcaccaggatggctttgagcaataagagttggccccagtaagtcgtaagcgtggggggaaatccggtaatcaacaatgcattaagcacgccgcttgccagtacgccgatcaccgcaaaatgcccgcaccaggaaaaacgcatcagcgcctgaatagcctggtgtcgccaacggcctttgatgagttgcatacaccagagcaccggcagtaatcccccaaaccacgccgccgcacaaatcaggtgaatcgcgtgattagtctgatggattttcgctgttaccccttcattcagcgtcgcatgccccactcccgccagcagaataaattgcgcggtagtgagcataaacagcaaacgtggcatattccgcggttgcataagggcgacgatcaacgttacgagggcgagaacaatttgccataaccagatgccaccaaactgcgtttgcaaaacagcctgccaaatgtttggcgaaaatacatctgtccatcccgttcccatcaacccgccctgaacggcgagcattgcagtggcactgatcaaactccagacggcagcgtgctgttgtaaacgcagaaaacgcttcgccagcaagcgacgaatcgtcaagggggccagccaggcaccgtacattgcgaagccaaaaaccagcatcagcgaggtgaaatggataaatcgcagcgcgatccaggtaaacgccagcatgatttatttcacgctaaaggtgtagtgtcctttcgttttatgcccgtccaccgaaacaacatgccagtcaacggtgtaggttccgggtttcagcgaatcggccagtggaacaatcagttgcttttggtcctgctcatttcgcttcgccggtaatgttttaatattttcgttttttggccccgtgatttttgcaccactgaatcctgtttcaacaccttccgagaagtttaaagtgattgcctgcggtgcagctgtcacttgcgcgtttgccgcaggatactgatgcgttaaatgcgcatgtgcccagacggaaggtgtcaccaacgaagtggtcaggattgccagcgcgtagcgaagggagcgtgcagttgaagccatattatctattcctttttgtaataacttttttacagagcataaccttgtctaatgtctgagtcgaggatcatcaattccggcttgccatcctggctcactcttagtaacttttgcccgcgaatgatgaggagattaagaatgctgaagaatctggctaaactggatcaaacagaaatggataaagtgaatgtcgatttggcggcggccggggtggcatttaaagaacgctacaatatgccggtgatcgctgaagcggttgaacgtgaacagcctgaacatttgcgcagctggtttcgcgagcggcttattgcccaccgtttggcttcggtcaatctgtcacgtttaccttacgagcccaaacttaaataaaacttatacagagttacactttcttacataacgcctgctaaattatgagtattttctaaaccgcactcataatttgcagtcattttgaaaaggaagtcattatgtcgttctggaaagttgcagcagcgcaatatgagcctcgtaaaacctcactcaccgaacaggtagctcatcatctggagtttgtgagggccgccgccaggcaacaatgtcagctgttagtttttccatcgctttctttactggggtgtgattattcgcgacgtgcccttcctgccccacccgatctctcactgttagacccgctttgttatgccgcaacgacctggcgaatgaccatcattgccggccttcccgttgaatataacgatcgctttattcgtggaattgcggtgttcgcaccgtggcgaaaaacgcctgggatctaccatcagagtcatggtgcatgtctgggccgtcgttccagaaccatcacggtggtcgatgaacaaccgcaaggtatggatatggacccgacctgttcactgtttactacagggcaatgtctgggagaacccgacctgctggcgtcggcccgtcgcttacaatttttttcacatcagtactcgattgccgtgctgatggcaaatgcccgtggtaacagtgcactatgggatgaatatggtcgtctcatcgttcgcgccgatcgtggttcattattgttagtcggtcagcgttcatcacagggttggcaaggcgatatcattccattacgctaggctttttcggcctggagcatgccatgttgcgcattatcgatacagaaacctgcggtttgcagggagggatcgttgagattgcctctgttgatgtcattgacggaaaaatcgtcaaccccatgagccacctggtgcgccccgatcgtcctattagtccacaagcgatggcgattcatcgcatcaccgaagccatggtcgccgataaaccgtggattgaagatgtgatcccacactattacggtagtgaatggtatgtcgcgcataacgccagctttgaccgccgcgtactgcctgagatgcccggtgagtggatttgcactatgaaactggcccgtcgtttgtggcctgggatcaagtacagcaatatggcgttatataaaacacgcaagctcaatgtacagacgccgccgggcctgcatcatcaccgcgcgttgtatgactgttatatcaccgccgcgttgcttatcgatattatgaacacctccggctggacggcagaacagatggccgatatcaccggacgtccgtcgttgatgacgaccttcacctttggcaaataccgtggcaaagcggtttccgacgttgccgaacgcgatccgggctatctgcgctggttatttaataacctggacagcatgagcccggagctgcgtttaacactgaaacattatctggaaaatacttagtccgcaggcgtagcgggtaatgttccctgcgccagcgcgaccagaaaagcatattccatcgctacgccttcgtacgatttaaagcgaccagatttaccgccatggcctgagtccatgtcggtacagagcaataaaagatggtcatcggttttcagctcgcgcaatttagcgacccattttgccggttcccaatattgcacctgagaatcgtgcaaaccggtcgttaccagtaaatgcggataagcctgtgcggtgacgttgtcatacgggctgtagcttttcatgtactcgtaatattgcggatcctgcgggttaccccactcttcaaactcaccagtggtaagaggaattgattcatcaagcatcgttgttacaacatcaacaaacggtacctgggcgataacgccgtggaataattccgggcgttgattaattgcaacgcccatcaacatgccccccgcactcccgcccatcgcataacaaagcgaaggagagccatagcccagttttaacaatgcatcgcaggcatcaagataatcattaaacgtatttttcttcttcagaaattttccgtcttcgtaccattgttgccccagctcaccaccgccgcgaacatggacaatggcgtagacaaagccacgatctaacaaactcaagcggctaaaactgaaatcggcatcaatacttgcgccgtaagaaccatagccatacaccagcaacgggttgtgtcctttgcgaaaatgtttgcgatggtagaccaacgaaaccggaacttcgacgccatcacgggcgactatccacaggtgttcactgcggtaattcgccgcataaaaaccaggaacttccgtttgttttaatacacgacgctcaccggtatccatatccagttcaaacaaagtgtctggtgtagtcatggaagaataaccataacgcaatcgcgcggtttcaggttctggattgtaggcaatccaggtcacataggccggatcatcaaaggcaataccaatgacttcccgggtcttgcggttaatttggcgcaaactggttaacccgcgctgacgctcttcaaccaccagccagtcggtaaacagcgtaaacccttccagcatgatgttttcgcgtggcggaattaactcttcccactgttgctcatcacgcatacgggtacggtataagccaaagtttttgccgtggcggttggaacgcagataaaaacgatgctggtagtgatcaaggctgtattcgtgatctttgcggcgcggcagaaaaacaaacggctcggcatcggccatttccgcgtccagcaggcgaacttcactggtggtggcgctggccaaatgaatgactacatagtgcttcgaggtcgttttatgcaggctgacgtaataggtatcgtctttttcttcgtagatcagtttatcttgcgatgctggcgtaccgatggcgtgacgccagacctgataaggcagcagcgtcaccggatgcttgcgaacatagtagaaaatccaggagtcatttgcccagacaaagctgggttcaacgttatccagcagttccgggtaccagttaccagtttccagattacgaaaacgaatgccgtactggcgtcgggaaagaaaatcttctgccagcgccataatggtgttatcgggcgtaatcgccattccgcccatcgaataaaactcactatgagctgcgcgcttattggcatcgagcaatgtttcccactcatcccactcttcactgaatgccgattgacgctggtagatagcatattcacagcctggttcataaatatgccgatagcggtagccatttttgatgtagggcgcagaaacttctcgttgcggaatgcggtcgatgatttcctttaagatgcgatcctgcaaggcttgttgtgaggccatcacccgatgaccgtaactattttcttgttgcaggtagtccaggacttctggctgagaacgcgtatcgtcccgcagccagtagtaattatcgatgcgcgtatcgccatgaagcgtcatggcgtggggaatgcgggcggcttttggtagcatgttattgttctttctggttgaaacatcttataagggtggcaaaactcaccggggatgcaagcgaaacaggggagtcattgcttagatgatgacaggtaatggcgcggatatcgaatgttatgcagacagagaaaatcagcctgttcaaatggctgtgcgattctggatagcccgaaatagtcaacttcaggctatccagagagcggaattattccgccaaagtgcgtttttgctgttcgagatcgcgttcaatgccgtcacgaacatcctgggggattttcagcgcgtcacccagtgcattcaggtaactgcgttccataaaatggtcaatatcaatagccgcgcaactcaggaaatagatttccagcgcctcttcttcattgcggaccccggtagccaggcgttgtggatccagcggttgttcgattgcctgctcaatgagtacacgcccctgctcttccacgccggctccacgcaattgctggtcgattgccgcacgttctttggcatcaatatgaccatcacttttagcggcaaagaccagcgcaaggatcaaacgtgctgtacgctcatccagcggcgtactttgcgcgccaaactgcggttcgtcctgatgcgccgcgcgaattttatctttgtatttattccacagcaccgtacccgctaccgctccgccgccaaccagtaacgcgttggtgccatatttcgtaagaagtttacgtgctgatttatttgcgaccagcagcccagccagtccgcctaatgcgcctggcactaacagtttgaccaatccctgatccgcagacgaggaggtagaagaactgctttgcccaagcagggattgcagttgatttaaccagttagccatatttgctcctcaataaccatttttagtgcctgtagcatagcggatgaggatgtcagaaaatgtatatcgagacaaaagatgcgcaaataagcggggcggtaggccgttattcaaagaaattcgcgccaggtaaggtatttactgtatatcaggtgataagggtattttaggtgaaagtagtttgtcgttttgagtggcattgtttgatgctgattgcccgatgcgacgctgttgcgtcttctcaggcctacgattgtggtgcgttctggggcggacaaggcactcgcgccgcatccgccaacagtcaatcgaattatcagaagccattaacgccgctgatattccgccattcccgctttgcagtccacgctgacctggtaatgaatatcggcacttttaccacgcacggttagcggtactgaccatttatcatctttaccctgaatgtcctgcaaactgacccaagccacgggatcggcctgaccgacaattttttgatcatctgcccaacgcgccacgcgattttgttgataatcacgttttacgctcgcggcaattccggcagcatccagatcttcacactttgggaaagtgaccgacttgctggtttcattattggcagcgaaaactgatgcgcaggcagaaaccaacaacagccctaaaaacgcccctctttttttcatgtttttctccatagcacaatgattcaggagaaagcatggtacaaattgtcaggagcgcaagttgcttcaggccgcgtgtgaggcatcttcctcttcggattcagcaccgacgacctgtggggacggtaatttgccggttttcagaatggtgctcagcacatctttttgttctgccagccatagcgaaagggcttcacgttgctcgtcttccatttgcactggagaatttgtcagccaggtgtcaagcagatccgccgtatcaagcattttgtcataagcatcggcttcctttttgctggtaaacgacattttctcttcgccctcacgaatgactacgtatttaacttcaaccgccatttgcagcctctcataataactgtgattttatacagtatatttcttttcggttgagaaatcaacatcagcaataaagacacacgcaaacgttttcgtttatactgcgcgcggaattaatcaggggatattcgttatgacgttattaggcactgcgctgcgtccggcagcaactcgcgtgatgttattaggctccggtgaactgggtaaagaagtggcaatcgagtgtcagcgtctcggcgtagaggtgattgccgtcgatcgctatgccgacgcaccagccatgcatgtcgcgcatcgctcccatgtcattaatatgcttgatggtgatgcattacgccgtgtggttgaactggaaaaaccacattatatcgtgccggagatcgaagctattgccaccgatatgctgatccaacttgaagaggaaggactgaatgttgtcccctgcgctcgcgcaacgaaattaacgatgaatcgcgagggtatccgtcgcctggcggcagaagagctgcagctgcccacttccacttatcgttttgccgatagcgaaagccttttccgcgaggcggttgctgacattggctatccctgcattgtaaaaccggtgatgagctcttccggcaaggggcagacgtttattcgttctgcagagcaacttgctcaggcatggaagtacgctcagcaaggcggtcgcgccggagcgggccgcgtaattgttgaaggcgtcgttaagtttgacttcgaaattaccctgctaaccgtcagcgcggtggatggcgtccatttctgtgcaccagtaggtcatcgccaggaagatggcgactaccgtgaatcctggcaaccacagcaaatgagcccgcttgcccttgaacgtgcgcaggagattgcccgtaaagtggtgctggcactgggcggttatgggttgtttggtgtcgagctatttgtctgtggtgatgaggtgattttcagtgaggtctcccctcgtccacatgataccgggatggtgacgttaatttctcaagatctctcagagtttgccctgcatgtacgtgccttcctcggacttccggttggcgggatccgtcagtatggtcctgcagcttctgccgttattctgccacaactgaccagtcagaatgtcacgtttgataatgtgcagaatgccgtaggcgcagatttgcagattcgtttatttggtaagccggaaattgatggcagccgtcgtctgggggtggcactggctactgcagagagtgttgttgacgccattgaacgcgcgaagcacgccgccggacaggtaaaagtacagggttaaacccggcaaaaaaacgctacaaaaatgcccgatcctcgatcgggcattttgacttttacagcttagcgccttctacagcttcacgcgccagcttagtaatgcggtcgtaatcgcccgcttccagcgcatctgccggaaccagccaggaaccaccgatgcacagcacgcttttcagcgccaggtagtcacggtagttagccggagaaataccacccgtcgggcagaaacggacctgggagaacggacccgcgatcgcctgcagggctttcacgccgccgttagcttcagccgggaagaatttgaactctttcaaaccgtagtccatacccagcatcagttcggaaacagtgctgatccccggaatcagaggaatagtcccttcggtagcagctttcagcagcggctcggtcagacccgggctaattgcgaactgtgcacccgcttcagtgacttctgccagctgctgtggattcagcaccgtaccggcacccacaatcgcttcaggcacttctttggcgatagcacggatagcgtcaactgcacactcggtacgcagagtcacttccagaacgcgcaccccaccagcaaccaacgcttttgccatcggcaccgcgtgttccagtttttttaccacgataaccggtacaaccgggccggtggtcaggattgattctgcacttgttttccagtttttcatcagagttttctctcgcctgattacaaatttgtcgtcttaaaaagtgatacaggttgcgccctgttcggcaccggacagtttttcacgcaaggcgctgaataattcacgtcctgttcccacgcgtgacgcgctcaggtcaggaatgtgcggttcgcgagcagccagttccgcttcgtctaccagcagcgtcagttcgcctgtctgtccattcacacgaatgatgtccccgtcgcgcacttttgccagcagcccgccatcgtaggcttctggtgttacgtggatagctgacggcactttacctgaagcgccggagagtcgtccatcggtaactaacgcaattttgaaacaccggtccaataatacaccaagtggcggcatgagtttatgtaattctggcattccgttcgcttttggcccctgatgacggacaacaacgacacaatcgcggtccagcaaacccgcttcaaaggccggcataacgtcatgctggctttcaaaaacaaccgctggcgcttcaatcacctggttctcaaccggcacggcagaggttttcataaccgcacggcccaggttaccgcttaacacttttgtcccaccatgatgagagaaaggttgttcgaaggaagcgatcacattgctgtcgagtgatttttccgccccttcccgccagtccagttcaccattattcagccatggttcaagggtataacgagacagaccaaaacctgccaccgtattgacatcttcatgcagcaggcctgctttgagcagttcacgcaccagaaccggtacgccacctgccgcctggaagtggttaatatcggccggaccgttcgggtagagacgtgccatcagcggtacaacatcagaaaggtcagagaagtcatcccagttaatctgaataccggccgcgcgcgccatcgccaccaggtgcatggtgtggttagtggaaccaccggtcgccagcagtgcaacgataccgttcaccaccactttctcatcgatcatcttaccgatcggcatccattcattaccattaccggtcatgcgtgtaacctgacgcgcagctgcggcggtcaaagcatcgcgcagcggagaatccggatgaacaaaagaagagcctggcaactgcatccccataaactccaccaccatctggttggtgttggcagtaccgtagaaagtacatgttcccggcgcatggtaagacgcggcttctgactccagtaaggccatgcggtccactttaccttcggcataaagctggcgaatacgcactttttctttatttggcaaaccgcttgccatcggtccagacggcacaaacaccgcaggcaaatgaccaaacgacagggctgccatcgtcagacccgggacaatcttgtcgcacacaccgaggaacagagcaccatcaaacatgttatgggacagccccaccgccgcagacatcgctatcacttcgcggcttagcagcgacaattccattccatcctgcccctgggtgacaccatcacacatcgccggaacaccgcccgcaacctgaccaaccgcattcgcttcatgcagggctttacgaatgatttctggatagtgttcataaggctggtgcgcggagagcatgtcgttataggaggtgatgatggcgatattgttacgcaacatgcttttcaaagaggctttgtcttctggctggcaggcagcgaaaccgtgtgccaggttaccgcatgccaactgcgaacgatgaacggtcgaagttttcgcttgttctatccgggcgagataagcagagcgagtctcgcgcgaacgttcaatgattcgatttgttacgcgtaacaattgtggattcataaaggctcctgaaattgagttgtcagagcaggatgattcacaacgcgtttcattcagaggatttatgactgaaacgcctgtaaccggagctcatagggcaaaaacgtttcagtcagtgtaataaaaaaagcctcgtgggtgaatccgcacgaggcctgaaagtgtaaaaattgttctacaatctgcgcaagatcatgttaccggtaaaataaccataaaggataagcgcagatattactcaaactcattccaggaacgaccatcacgggtaatcatcgccaccgaggcaacgggtccccaggttccggcctgatacggtttcggcgcatcattgtccatcgcccacgcctcagtaatggagtctacccatttccaggcttcttccacttcgtcgcgacgtacaaacagtgcctgaataccacgcatggtttccagcagcaaacgttcataggcatccgccagatgcgtctgattaaaggtttctgaatagctcagatccagcttggtgatttgcaggttatgtttgtggtcaaggccaggaactttattcagtacctggatatccacgccttcatcaggttgcagacggatagtcagtttattctgcggcagatcctgccacgattctttaaacagattcagttcaggtgttttgaaatagaccacgacttcagaacatttggtcggcagacgtttaccagtacgcaggtagaatggcacaccggcccagcgccagttatcaatgtcgacgcggatcgccacgaaagtttctgtattgctgctcttgttcgcgccctcttcttccagatatcccggcacttttttgccctgggcgaagcccgcagtatattgcccgcgtacggttttttcgcgtacgttggagcggtcgatgcggcgcagagacttcagtactttcactttttcatcgcggatgctgtctgcgctcaggtcagacggcggagacatcgcaatcatgcaaagaatttgcagcaggtggttctggatcatgtcgcgcatctgaccggctttatcaaaatagccccagcgcccttcgatccccacttcttctgccacggtaatctcaacatgatcaatggtgcgattgtcccagttattcacaaacagggagttagcaaaacgcagcgccaacaggttcagcaccgtttctttaccaagatagtggtcgatacggtaaacctggcactcctcgaagtattcgccaacctgatcattgatttcctgcgaggtcgccagcgacgtccccagcggtttctccatgactacgcgtgccggtttagcattcagttttgcctcgccaagccctttgcaaattgcgccaaaagtgctgggcggcatggcaaagtagttaatggtgatacgatttttttgatccagcatcgcgccgagacggctgaatgcagcagtgtcattgacatcgagattacaaaaatccagacgtgcactcagggtgtcccataaaccttcatcaatggtttctttcatgaaagtttcgagcgcctcgcggacaactttggtatatgccgctttatcccagtcagcacgccctacgccgataatccgggtgtccgggttgagctgaccggctttttccagttgatacagggaaggcagcaatttacgacgcgcaaggtcgcctttcgcgccgaaaatgaccaggtcacaggcctgggctgtttgcgttaccgccatgtcattctccttaagttaactaacccggtacttaagccagggtatacttgtaattttcttacggtgcactgtactgcttttacgagcttgcgaaaactgtaaacgcttatccacccgtgcgattacgggaaaagcgcgcaaagtgcggcaaaactgataaaaaaatcatcgttttccattgggtaaaaatctgacactgatcatgttatgaaaaaaaataacaacttttttatctgcttttgtcattaacacggcacacaggcgtaatatctgacaaaactgcatttcgatttctttcagtgcggaaatcgtcattacccgtgagtctctttacatcatgaatatgctggaaaaaatccagtctcagctggaacatttgagcaaatcagagcgcaaagttgccgaggtcattctggcttcgcccgataacgcgatccattcgagtattgctgctatggcactggaagccaatgttagcgaaccgacggtgaatcgtttctgtcgcagcatggacacgcgcggttttcctgattttaaacttcatctggcacagagtctggcgaatggcactccctatgttaatcgcaatgtcaatgaagatgacagcgttgaatcatacacagggaaaatatttgagtccgcaatggcaacgcttgatcatgtccgtcattcactggataaatctgccatcaaccgcgccgtcgacttgctcactcaggcaaaaaaaatcgcctttttcggattaggctcttcagccgccgttgcccacgatgcgatgaataagttctttcgttttaatgttccggtggtgtactccgatgatatcgtgctgcaacgcatgagttgtatgaattgtagcgacggagacgtggtggtgctgatttctcacactggaagaacaaaaaatctggtcgagctggcgcagctggcacgcgaaaacgacgccatggtgattgccctcacctctgcgggtaccccgctcgcccgggaagcaacgctggcaattaccctcgacgtaccggaagatactgacatttatatgcccatggtttctcgacttgcacagctgaccgtgatagatgtgctggcgacaggatttactttgcgacgcggtgcaaaattcagagataacttgaagcgggtcaaagaagcgctgaaggaatcgcgttttgataagcagttacttaatttaagtgacgatcgctaaaaacgactgtcactgtcctaatcttatacgacatccgaatgagattaatttatcgccatcgcggcgttatttcattcggatttcatgttcaagcaacacctggttgtttcagtcaacggagtattacatgtccagaaggcttcgcagaacaaaaatcgttaccacgttaggcccagcaacagatcgcgataataatcttgaaaaagttatcgcggcgggtgccaacgttgtacgtatgaacttttctcacggctcgcctgaagatcacaaaatgcgcgcggataaagttcgtgagattgccgcaaaactggggcgtcatgtggctattctgggtgacctccaggggcccaaaatccgtgtatccacctttaaagaaggcaaagttttcctcaatattggggataaattcctgctcgacgccaacctgggtaaaggtgaaggcgacaaagaaaaagtcggtatcgactacaaaggcctgcctgctgacgtcgtgcctggtgacatcctgctgctggacgatggtcgcgtccagttaaaagtactggaagttcagggcatgaaagtgttcaccgaagtcaccgtcggtggtcccctctccaacaataaaggtatcaacaaacttggcggcggtttgtcggctgaagcgctgaccgaaaaagacaaagcagacattaagactgcggcgttgattggcgtagattacctggctgtctccttcccacgctgtggcgaagatctgaactatgcccgtcgcctggcacgcgatgcaggatgtgatgcgaaaattgttgccaaggttgaacgtgcggaagccgtttgcagccaggatgcaatggatgacatcatcctcgcctctgacgtggtaatggttgcacgtggcgacctcggtgtggaaattggcgacccggaactggtcggcattcagaaagcgttgatccgtcgtgcgcgtcagctaaaccgagcggtaatcacggcgacccagatgatggagtcaatgattactaacccgatgccgacgcgtgcagaagtcatggacgtagcaaacgccgttctggatggtactgacgctgtgatgctgtctgcagaaactgccgctgggcagtatccgtcagaaaccgttgcagccatggcgcgcgtttgcctgggtgcggaaaaaatcccgagcatcaacgtttctaaacaccgtctggacgttcagttcgacaatgtggaagaagctattgccatgtcagcaatgtacgcagctaaccacctgaaaggcgttacggcgatcatcaccatgaccgaatcgggtcgtaccgcgctgatgacctcccgtatcagctctggtctgccaattttcgccatgtcgcgccatgaacgtacgctgaacctgactgctctctatcgtggcgttacgccggtgcactttgatagcgctaatgacggcgtagcagctgccagcgaagcggttaatctgctgcgcgataaaggttacttgatgtctggtgacctggtgattgtcacccagggcgacgtgatgagtaccgtgggttctactaataccacgcgtattttaacggtagagtaagtacgttgccggatgcggcgaaaacgccacatccggcctacagttcaatgatagttcaacagatttcgaatattctgaagcaaacttgaacttatcatcaggcgaaggcctctcctcgcgagaggcttttttatttgatgggataaagatctttgcgcttatacggctggatttcgcccggtttgcgagttttcagcaattttagtatccaggtgtattgttctggtcgcggaccaacaaaaatctcgacttcttcattcatccgccgcgcaatcgtatgatcatccgcctctaacagatcatccatcggtgggcgcacctgaatcgtcagacgatgcgtcttgccatcataaatcggaaacagcggtacaacgcgcgcacggcacactttcatcaaacgaccaatcgcgggcaacgtcgctttataggtggcaaagaaatccacaaattcgctgtgctctgggccatgatcctgatcgggtaaataatatccccagtacccctgacgtaccgactggatgaatggtttaataccgtcatttctcgcatgcagacgaccgccaaagcgacgacgcaccgtgttccagacataatcaaaaaccgggttgccctgattatggaacatcgctgccattttctgcccttgcgaggccatcagcatggcaggaatatcgacggcccaaccgtgcggcaccagaaagataactttctcgttattacgccgcatctcttcgatgatctccagcccttgccagtcaacgcgcggctgaattttctccggcccgcgtattgccaactcagccatcattgccatcgcttgcggcgcggtggcaaacatctcatcaacaatcgcttcgcgttcagcttcactacgttctggaaagcagagcgacagattgattaacgcacgacggcgtgagctttttcccagtcgtccggcaaaacgtcccagccgtgccagaatgggatcacggaactttggcggcgttaaagcgatacccgccatcgctgctacgcccagccatgctccccagtagcgcgggtggcgaaaggatttatcaaactcaggaatgtattcgctattattttttttcgtttccatgcttttccagtttcggataaggcaaaaatcaatctggtgatagtgtagcggcgcaacttgccccgcaccaaataaaaaaagccggtactgactgcgtaccggctgcgaatggatgttaattaatcaaaccgtagctgcggcacaatctctttggcctgcgccaggaattcgcgacgatcggagccggtcagcccttcggtacgcggcagttttgccgtcagcgggtttacggcctgctggtttatccatacttcatagtgcagatgcggcccggttgaacgtccggtattaccggaaagcgcgatacggtcgccacgtttcaccttctgtcccggtttcaccagaatcttgcgcaagtgcatataacgcgtggtgtagctgcgaccatgacgaatagccacataataacctgctgcgccactgcgtttggcaaccaccacttcaccgtcacccactgaaagcactggcgtaccctgcggcatggcgaaatcaacacctctgtgtggtgcaacgcgaccggtcaccggattagtacgacgcgggttaaaattagacgagatacggaactgtttcgccgtcgggaatcgcaagaatcctttcgccagaccagtaccgttacgatcgtagaatttgccatcttcagcgcggatagcgtaataatctttaccttctgaacgcaaacgtacgcccagcagctggctttgctcacgtttaccatcaagcatttctcgagacattaacaccgcaaattcatcgccttttttcagtttgcggaaatccatttgccactgcatggctttaatcactgcgctcacttcggcgctggttaaaccggcgtttctggcgctggcaacaaagcttcccccgacggtacctttcagcagattgttaacccactctccttgctgcatttcgctggtcattttaaaaccgttagcggcagtacggtcataggttcgggtttcacgacgagacacttcccaggtgaggcgctgcagttcgccgtccgcggttaatgtccaggagagttgttgaccgattttcaggttacgcaattctttgtcggccgcagccagttgggtgatatcacccatatcaataccatactgattgagaatgctgcttagcgtatcgccagtggaaacaacatattcatgcacgcccgcttcaccggcgattttgtcatccagttcgtcctggggaatggcttcatcttcttgtgcagcttgatcaatcggctcactggcttcaggtaagagcgaacgaatttcgttctgttccagctcaatggttttgacaattggcgtggcatcacggtgataaacataaggccgccagacagcgacggccagagtaagaacggtgagcgaccccaacataacgcggtgtggtcgcggtaaattattaaacgccagggcgacagagcgggctatctgttgcacgtaatcacttcctcattaatctcctttcaggcagctcgcatactggttggctaattgactcaggaattctgaatagcttgttttacccagtttgatattcgtccccaggggatccaacgttcccatacgaacggatgtccctcgtgcgacgctctcaacgaccgctggcctgaactgtggctcagcaaaaacgcaggttgctttttgctcaaccaactgtgttcttatttcatgtaaacgctgcgcgccaggttgaatctcagggttaacggtaaaatgaccaagcggtgtcagtccaaactgtttttcgaaatagccgtaagcatcgtgaaaaacgaaataacctttccccttgagcggcgcgagctcgttaccaacctgcgtttcggttgaggctaattgtgcctcaaaatccttcaggttggcgtcaagtttggctcgactttgcggcataagttccactaattttccatggattgcaaccgctgtagcccgcgctatctctggggaaagccaaagatgcatgttgaaatcgccgtgatggtgatcttcgtcacttttttccgcgtggtcgtgatcatcatcatcgccgtgaatacttttcatcagtagcggtttcacatcttcaagctgcgcaatcgttacctgcttcgctcctggtaatttgcttaccggtttttgcataaacgcttccatctccgggccaacccaaacgactaagtccgcgttctgtaagcgttttacatccgatgggcgcagtgaataatcatgttctgaagcgccgtcaggaagtaaaacctctgtttctgttaccccatcagcaatggcagaagcgatgaacccaacgggtttaagcgaagcgacaacggcggcatctgcggcctgtgttgcacctccccagagagcggcggataatgctgcgaaaagaagcgtttttttatgtaacataatgcgaccaataatcgtaatgaatatgagaagtgtgatattataacatttcatgactactgcaagactaaaattaacatgacaagtctggtttccctggaaaatgtctcggtttcttttggccaacgccgcgtcctctctgatgtgtcgctggaacttaaacctggaaaaattttgactttacttgggccaaatggcgcaggtaagtcgacactggtacgggtagtgctcgggctggtaacacccgatgaaggggttatcaagcgcaacggaaaactgcgcatcggctatgtaccgcagaagctgtatctcgacaccacgttgccactgaccgtaaaccgttttttacgcttacgccctggtacacataaagaagatattttgcctgcactgaaacgtgtccaggccgggcacctgattaacgcaccgatgcaaaagctctctggtggcgaaacgcagcgtgtactattagcgcgagcattgttaaatcgcccgcaattattagtgctggatgaacccactcaaggcgtggatgtaaatggccaggtggcgttatatgaccttattgaccaactgcgtcgtgaactggattgtggcgttttaatggtttctcacgatctgcatctggtgatggcaaaaaccgatgaagtgctgtgcctgaatcaccacatttgttgttccggcacaccggaagttgtttccctgcatccggagtttatttcaatgtttggtcctcgtggtgctgaacaactgggtatctatcgccatcatcataaccatcgtcacgatttacagggacgaattgttttgcgtcggggaaatgatcgctcatgattgaattattatttcccggttggttagccgggatcatgctcgcctgtgccgcgggtccgctgggttcgtttgtagtctggcgtcgtatgtcttatttcggtgatacgctggctcatgcctcattacttggcgtcgcgtttggtttgttgctggacgtgaatccattctatgcggtgattgccgttacgctgctgctggcgggcggtctggtatggctggagaagcgtccacagctggcgatcgacacgttattagggattatggcgcacagtgccctgtcgctgggcctggtggtcgtgagtctgatgtctaatattcgtgttgatttgatggcttacctgttcggtgatttgctggcagtgacgccagaagatctcatctctattgcgattggcgtggtcatcgtggtggctattttgttctggcaatggcgcaatttgctgtcaatgacgataagcccggatctggcgtttgttgatggtgtgaaattacagcgagtgaaattgttgttgatgctggtgacggcattgacgattggtgtagcgatgaaatttgtcggtgcgttgattattacttcgttgctgattattcctgctgctactgcgcgtcgctttgcccgcacgccggaacagatggctggtgtcgctgttttggtggggatggtggcagtgactggcggtttaaccttttccgcggtttacgatacgccggcgggtccgtcggtggtgctatgtgcggcactgttatttattctcagtatgatgaaaaagcaggccagctaatctatcgctgaacacatttgtcggatgcggcgcgagcgccttatccgacctacggttcggtatctctggtagtcctggtaagacgcgaacagcgtcgcatcaggcatattgccagtgccggatgcggcgcgagcgaccaatccgacttacggcatttctggcggcgttatgccaaagtgattccacgcccgcgtcgtcgccatacgcccacgcggtgtacgctgcaaaaagccttgctgaatcaaataaggttccagcacatcctcaatggtttcacgttcttcgccaatggctgccgccaggttatccagacctacaggtccaccaaagaacttatcgattaccgccagcaacaatttgcggtccatataatcgaaaccttcagcatcgacattcaacatatccagcgcctgagcagcgatatctgccgagatggtgccatcgtgcttcacttcggcgaaatcacgcactcgacgcagcagacggttggcaatgcgcggcgtaccgcgagcgcgacgagcaacttccagcgcgccgtcatcactcatctcaagccccataaagcgtgcgctgcgactgacgatatattgcagatccggcacctgataaaactccagacgttgcacaataccaaaacggtcgcgcaacggtgatgtcagcgaacctgcgcgcgtggttgcaccaatcagggtaaacggcggcaaatcaattttaatggagcgtgccgccggaccttcaccaatcatgatatccagttggtagtcttccattgccgggtacagcacttcttcaacaactggcgatagacggtggatctcatcaataaacagcacgtcatgcggttcaaggttagtgagcatcgcagccaaatcgcccgccttttccagcaccggaccagaagtcgtgcgtaaattaacgcccatttcattggcgacaatgttggcaagcgtagttttacccaaccccggaggaccaaaaatcaacaaatgatcgagggcatcgccgcgcagtttcgctgctttgatgaaaatctccatctgtgaacgaacctgcggctgaccaacatactcttccagtaatttggggcgaatggcgcgatctgctacatcttccggcaaagtggtaccggcagaaatcagacggtctgcttcaatcatcctttacctcataacgcggcgcgtagggcttcgcgaattaaagtttcactgctggcgtcagggcgagcgattttgctcaccatgcggcttgcttcttgtggtttatagcccagcgccaccagcgcggcaaccgcttcttgttcagcatcgtcggtcgccgggctggcaggagacgtgagtaccaggtcggcggctggcgtaaagagatcgccatgcaaacctttaaatcggtctttcatttcaacaatcaagcgttcggcggtttttttgccaatacccggcagtttcaccagtgcccccacttcttcacgctcaacggcattaacgaactgctgcgctgacattccggagaggatcgccagcgccaacttcgggccgacgccgttggttttgatcaactctttgaacaatgtgcgctcttgtttattgttaaaaccgtacagcagttgcgcgtcttcacgcaccacaaagtgggtgaaaacgatcgcttcctgacccgcttcagggagttcataaaaacaggtcatcggcatatgcacttcatagcctacgccgcccacttcaattaacaccagcgggggttgtttttcaatgatgatgcctctgagtctgcctatcacatgacgctcctgcgtaatgaatcaaagataatgctgtatgataaaaaaatgctggatagatatccagcgaaggatgaagaaaacttgcgaggtgtctcgatgaactgaaaaatggcacagtataatttattctacaggttatattggaagcaaatattttaatattacatattcagtgaagaaatgcgtaataaaaatatacattgcgcctcctgaaaaaataaattttttatgctattacgtatatttgtatctatttcaatggaatgacaacgtgaatattaattaccctgctgaatatgaaattggagatatcgtctttacatgtataggtgctgccttatttggtcaaatatcagctgcatcaaattgctggagtaatcacgtcgggatcattatcggtcataacggtgaagacttcctggttgcagaaagccgggttcccctttcaaccatcaccacgctatctcgttttattaaacgttcgtctaatcaacgctatgctataaagcgattagacgctgggctgacagaacgacaaaaacaacgaattgttgaacaggttccctcccggctacgcaaactttaccacaccggttttaaatacgaatcttcgcgccagttctgttcaaaatttgtttttgatatttataaagaagcgctatgtattccggtgggtgaaatagagacgtttggagaattgttaaatagcaatccgaatgcaaaactcactttctggaaattctggttcctgggttctattccgtgggagcgtaaaaccgtcacgccagccagtttgtggcatcatccgggtttggtgttgattcatgcggagggagtggaaacgcctcagccggaactgaccgaggcggtataacttaacgcagtcgccctctcgccaggttcagccgcgattcgctcatctgcatcgcattctgactaacgtggcagtgggtgatagcaatcgccagcgcatcggcggcatccgcctgtggattagcgggcagtttcagcaaggtgcggaccatatgctgcacctggcttttttcggcactgccaatacctaccaccgtttgctttacctgacgtgccgcgtattcaaatactggcaactcctgattcaccgccgccacaatcgccacgccgcgcgcctggcccagtttcagggctgagtcagcgttctttgccataaagacttgttcaatggcgaaataatcaggctggaactgggtgatgatttccgtcacgcccgcatagatgagtttcagacgagacggtaaatcatccactttggtgcggatgcatccgctacccaggtaggacagttgcctacctacctggcggatgacgccgtagccggtcacgcgcgaacccggatcaatgccgagaataatagccatcacgcgtctccgttttgctgtttagcaggcctcatcagagagtcgctgcgacctcatcagagatttcaccgttatggtaaacttcctgcacgtcgtcgcaatcttccagcatatcgatcagacgcatcagtttcggtgcggtttctgcatccatatcagctttggtagacgggatcatggaaacttccgcgctgtctgctttcagacctgccgcttccagagcgtcgcgcactttacccatttcttcccatgcagtgtagacatcaatcgcgccgtcatcataggtcacaacgtcttcagcacctgcttccagtgctgcttccatgatggtgtcttcatcgcctttctcgaaggagatcacgccttttttgctgaacagataggcaacggaaccatcagtaccgaggttaccgccacatttgctaaatgcatgacgcacttcagcaacggtacggttgcggttgtcagacagacattcaatcatgattgccgtgccgccaggaccgtaaccttcgtagatgatggtttccatgtttgcatcatcatcaccgcccacaccacgtgcaattgcgcggttcagtgtgtcacgggtcatgttgttagacagtgctttatccaccgccgcacgcagacgcgggttagcgtccggatcgccaccgcccagcttagccgcggttaccagctcacgaatgattttagtgaagattttaccgcgcttagcatcctgcgcagctttacgatgtctggtgttggcccatttactatgacctgccataaaaatatctccagatagccctgcctgttcaggcagcgttaattacaaactgttcaatcgcctgccggttgctccaggacttagtgagcgccgccgcagcaggcgcatcaagccacttgtaagccagatgttcagtgaaaacgatctgccgctcgtgcggaagcgcaagacagaaccatgattccgtattacgcgtcacgcccggcgcatagcgatgacgtaaatgtgaaaaaatttcaaactctaccgtgcgctgacagtcaattaaggtcagttgttcagcgacaacatcaatggtgacctcttcctttacttcgcgcatggcagcttgcggcgcggtttcaccctcttccacgctgccggttaccgactgccagaaatcgggatcgtcacgccgctgcaacatcagcacccgtttcgtatcttgtgcgtagatgaccactaagatcgaaacgggacgcttatacactttatccttcacgctgcctcttcgttgactgccttcgctcatcccattcacatagttatctatgctcatgggagttcactcagttgccgcctcgatgcaacgcgaatgatttcgtgtatttgagtcatatcagttattctcagccttcttcacaacctgaatgctcagctcagccagtgcagtcgggttagcaaagctcggtgcttcagtcatcagacacgctgccgccgtggttttcgggaaggcgataacgtcacggatattgtcggtgccggtcagcagcatggtcagacggtcaagaccgaatgccagacctgcgtgcggcggagtaccgtatttcagagcgtcgagcaggaagccgaatttctcgcgctgttcctcttcgttgatacccagaataccaaacaccgtctgctgcatatcaccattatggatacgtactgaaccaccgcccacttcgtaaccattgatgaccatatcgtaagcgttcgccaccgcattttccggtgcagctttcagttctgcagccgtcatatctttcggtgaggtgaacggatggtgcattgccgtcaggccgccttcaccgtcgtcttcaaacatcgggaagtcgataacccacagcggtgcccatttgctttcgtcggtcagaccaaggtctttacccactttcaggcgcagtgcacccatcgcgtcggcaacaattttcttgttgtcggcaccgaagaaaatcatatcgccatcttgcgcggcagtacgatccaggatgtcttcgatgatttctgcattaaggaacttcgctaccgggctgttgataccttccagacctttcgcgcgttcgttaactttgatgtaagccagacctttcgcgccgtagattttaacgaagttaccgtattcgtcgatctgcttacgggtcagcgatgcgccgcccggaacgcgcagagccgctacgcgacctttcggatcgttcgccggacctgcaaatacagcaaactcaacagatttcagcagatcagcaacgtcagtcagttccatcgggttacgcagatccggtttatcagaaccataacggcgttctgcttccgcaaaggtcattaccgggaaatcgcccagatccacacccttcacttccagccacagatgacgcaccagcgcttccatcacttcacgcacttgcggcgcggtcatgaaagaagtttccacatcgatctgagtaaattcaggctgacggtcagcacgcaggtcttcgtcacggaagcatttaacgatctgatagtaacggtcaaaaccggacatcatcagcagctgtttgaacaactgcggggattgcggcagtgcgtagaatttacctttgtgcacacgagaaggcaccaggtagtcacgcgcgccttccggcgtggctttggtcagcatcggagtttcgatgtcgaggaagccgtggtcatccataaaacggcgcaccaggctggtgattttagcgcgggttttcaggcgctgagccatttccggacgacgcaggtcgaggtagcggtatttcagacgcgcttcttcggtgttgacgtggttagagtcaagcggcagaacatctgcgcggttgatgatagtcagcgaggacgccagcacttcgatttcgccggtcgccatatcgcggttaatatttttttcgtcacgcgcacgtacggtgcccgtgacctgaatgcagaactcattacgcagttcagaggccagctttaacgcgtccgcacgatccggatcgaaaaatacctgcacgataccttcgcggtcgcgcatatcgatgaagatcaggctaccaagatcacgacgacggttgacccaaccacacagagtcacctgctgccccacgtgggacaaacggagctgtccacaatattctgtacgcatgagatatcccttaacttagctgccggcggatgccccctgctgcgcaggtgaccaagtcgcagcgttagctgtatgtcacaactgaatgaaaaaaggcggctattatactggaaattctgccgcaccgtaagagcctggcccgcgctggaacgcctcgttaccactttatatcgggcctgaaatcagactctacgccagtttgctataaaggtgttgcccgaactcataaaaattaacaaaatttgtcgttccgccatcggctaatcgcattaaggtgtgaggcacgattttgttttttcaggagtcattatgcttgaacttaatgctaaaaccactgcgctggtggtgatcgatttacaagaaggcatcttaccttttgccggtggtccacatactgccgatgaggtagttaatcgcgccgggaagctggcggcgaaatttcgcgccagcggtcagcccgtgtttctggtgcgcgttggctggtctgccgattacgctgaagcattaaaacagccggtcgatgcgccctcaccggctaaagtgttgcccgaaaattggtggcaacatcctgctgcattaggtgcaaccgacagcgatatcgaaatcatcaaacgtcaatggggtgcgttttacggtacggatctggagttgcaattacgccgccgaggtatcgatacaatagtgttatgtgggatctcgaccaatatcggtgttgaatccaccgcccgcaatgcctgggaacttggctttaatctggtgattgccgaagacgcctgtagtgccgccagcgccgagcagcacaataacagtatcaaccatatctacccgcgcatcgcccgtgtgcgtagcgtggaagagatcctcaacgcgttatgatttacatcggtctaccgcaatggtcgcatcctaaatgggtgcggttggggatcaccagccttgaagagtatgcccgccactttaactgcgtggagggcaacaccacgctttacgccctgccgaaacccgaggttgtcctgcgctggcgtgagcagaccacagatgacttccgcttctgttttaagtttccggcgaccatttcgcatcaggcagcattacggcattgcgatgatttagtgactgaatttttgacccgcatgtcaccgttggctccgcgcattgggcaatactggctgcaactgcctgccacattcggcccacgggagctgcctgcgctttggcattttctcgattctcttcctggcgaatttaattatggcgtggaagtccgccatccacagtttttcgccaaaggagaagaggaacaaacgcttaatcgcggtttacatcagcgcggcgttaatcgggtgattttagacagccgcccggttcatgcagcacgtccacacagtgaagctattcgcgacgctcaacgaaaaaaacctaaagttccggtacatgctgtactgacggcgacaaatccgctgatccgttttatcggtagtgatgatatgacgcaaaaccgggaattatttcaggtctggttacaaaaattagcgcagtggcatcagaccactacgccttatctttttttacatacgccagacattgcccaggcaccggaactggtacataccctgtgggaagacttacgtaaaacgcttccagagatcggagcagttccggctattccacagcaatcttctcttttctgaatttgccacctatcatagacaggtgccatcggccattttaaagggagtttgtatggtaagcgcgctgtacgccgttttaagtgcgttgttattaatgaagttctcttttgatgtcgttcgcctgcgaatgcagtaccgcgttgcctatggcgacggcggttttagcgaactgcaaagcgctattcgcattcatggtaacgcggtggaatatattcccatcgcgattgtgctgatgctgtttatggaaatgaatggcgcagaaacctggatggtgcatatttgcggcatcgttttgcttgctggtcgtctgatgcattattacggttttcatcaccgtctgttccgctggcgacgttccggcatgagcgccacctggtgtgcgctgttgctgatggtgctggcgaatctttggtatatgccctgggagttggttttctccctgcgttagcgcacaatacgccactttctttttcccggatttttacgttatgtctcaccgcgacacgctattttctgcccctatcgccagactgggcgactggacctttgatgaacgggtagctgaagtcttcccggatatgatccagcgttccgtacccggctattccaatattatttccatgattggtatgttagccgagcgcttcgttcaacctggtacgcaggtttacgatctgggttgttctctgggcgcggcgacgctctcggtgcgtcgcaacattcatcatgataattgcaaaattattgccatcgacaactccccggcgatgattgaacgctgccgtcgtcatattgacgcctataaagcccctacgccagtagacgtcattgaaggtgatattcgcgatatcgccattgaaaacgcatcgatggtggtgctgaattttaccctgcaattcctggaaccttccgagcgccaggcgttactggataaaatttatcaagggctgaaccccggcggcgcgctggtgctttcggaaaaattcagtttcgaagatgccaaagttggtgaactgttgttcaacatgcaccacgactttaaacgtgccaacggttacagcgaactggagatcagccagaagcgcagcatgctggaaaacgtgatgctgaccgattccgtggaaacccataaagcacgcctgcataacgccggttttgagcatagtgagctgtggttccagtgctttaactttggttcactggtggcattaaaagcagaggacgctgcatgatcgactttggtaacttttattctctgattgccaaaaatcatctttcacactggctcgaaacgctgcccgcgcagattgctaactggcagcgcgagcagcagcacgggttgtttaagcagtggtcaaatgcggtggagtttctacctgaaattaaaccgtatcgtcttgatttattgcatagcgttacggcagaaagcgaagagccactgagcgcagggcaaattaaacgcattgaaacgctgatgcgcaacctgatgccgtggcgcaaagggccgttctcactgtatggcgtcaacatcgataccgaatggcgttccgactggaaatgggatcgtgttctgccccatctttctgatttaaccggacgcaccattctggatgtcggctgcggcagcggttatcacatgtggcgcatgattggcgcaggcgcgcacctcgcggtggggatcgaccctacgcaactgtttctgtgccagtttgaagcggtgcgtaaactactgggtaatgatcagcgcgcgcatttgttaccgttaggtattgaacaacttccggcactgaaagcctttgataccgtcttttcgatgggcgtgctttaccatcgccgttcaccgctggagcatctatggcagttgaaagatcaactggtcaatgaaggtgaactggtgctggaaacgctggttattgatggtgatgagaacacggtgctggtaccaggcgatcgttacgcgcaaatgcgtaatgtctatttcatcccttccgcgctggcgctgaaaaactggctgaagaagtgtggttttgtagatatccgcattgcggatgtgagcgttaccaccacagaagagcagcgacgcaccgaatggatggttaccgaatcgctggccgatttcctcgacccacatgatccgggtaaaacggtggaaggttatccggcacctaaacgcgcggtgctgattgcgcgcaagccgtaaaggtctggtattactgccggatgcggcgtgaacgccttatccggcctacaaaaccttgctaattcaatatattgcagggactatgtaggcctgataagcatagcgcatcaggcagctttacgtttgcataacctcagcgcccgtttccgggcgctattcacgtcttacgcctgaacagctggctgatcaaacgccgttaacttcggtgcattgcccgtatatttttcgatatacaccaacgctgagttaccggcacaggcatttgccagctgcgagctggggatatccgccgttaacacgttcgcactgccgtttttacacaagccattttccagatctggccatgcaccttcatgcacgcataccacgccttttttgatcccgtcagtcaccaccgcgcctgtcaaaatctgaccacgtttgttccagacacgcaccagatcgccattcgcaataccaaagcgtgcagcatcttcggtgtgaatagtgattggttcacgatcggcgatcgcatattttttacgcagttccgcatagttaagctgactgtgtaaacggtgtgccggatgtgcggtcagaagctgtaactgcttctcgtcggcggtacctttccattcatcaggagccagccaggttgggtgtgccgggcaatccttatagccaaatttttccaacgtttttgaatagatttcaattttgccgcttggcgtacccagcgcatttttcaccggatcggcgcggaaatcaccataacgaacgtactgttcgttcttctcgctgtggcgcatttcgatcagtttattttgctgccagaaggcattaaacattggcatagtgacgcgttgcgcacgggcacctttctgagcggcatcatagaaaaatttcagccacgccatttcatctttaccttcggtatagatctcttttccgccaggtttgagtaattccgcaagatcggcaaacacgtcaaaatcgttacgcgcttcaaattgcggagcaacagcctgcttcatcggcacaatatgctggttgctgtaatcaccggtcatcgtcaagtcattgcgctcaaacgatgtggtgatcggtaatacgatatctgcgtgtttggctgctgcggtccagtagcattcagaaacgacgatcatctccggtttctgccatgctttaatcagacgattagtatcctggtgatgggtaaagttaccgccacccgcccaccagatcattttgatattcggatacgtttgttctttaccgttatgctgatatttgccgccaggattttccagcgcatcgacgatacgggcaacaggaatcgccgtcattccgccatcatcagcggcctcgctggcatgtccggcaatcgccgcagacatttccggcagcacgccgccaacacgcgtcgggttgccaccgttggagtaatgataagagaaaccaaaaccgccgcccggtgtaccaatctgccctaacatcgccgccagcgtcaccagcatccagtgtttctgttcaccatattgctggcgctgaattccccagcctgccatcagcattgtgcgattcgccgccatcagttcagcgagtttgactatctgcgcttccggtacgccagtaatttccgccgcccagaccgcgctcttcggcgtattatcgctcttacctgtcagatactcttcaaactgcggatacccggtagtgtatttttcaaggaacactttatcgtgtttgccttgtgtcatcagggtatgcgcaatccctaacatcagtgccacgtcggtgcccatattcggcgcgatccaggtggcattatcgtcaaagaattcgatggtttcggagcggataggatcaatggcaatcactggtttgccagattttttcagctgatggaagtattccagcccttgctcatcggtactgctccaggcaatttttaaggtattcagcgggttcattccccacagcaccacaacctggctgttttccagaatcagcggccaggaggtctgctgttcatacacctctacagaaccgaccacatgcggcatgatcacctgtgctgccccggttgaataatcgccgctatgcccggaataaccgcccgccaggttcatataacgttgcagtaaggtttgcgctttatgcaacacgccagaagagcgccagccgtaagatccggcaaaaatggccgatggtccgttagctttacgaatacgatcatgttgctcatgaatcagttttaatgcctgttcccagctcacctgtacataggtatcttcgccacgacctttcgccggttgcagtggattatcgagatagctttttctcaccatcggatgctgaatacgcgccgtggtgtgtacctgatccgccgccgtagactgtaaggaattcggtatggttttcgccagcgcgcctgttgaagaaacaatcttgccgtccttcacttctacgttcatcgctccccaacgtcccgcggtgaggattttaccgcccttctcttctgcccatgcggggagcggtgctgccgatgtcaccaccagcgctccagcggcaataccgctgtgtttaataaattcacgtcttgttaatgtcataacttcctccctgatcaacgaggatcactgtttctcggtaatatctttggcgttgtactggaaataccgcgttaaaatgtccagttcgttttcgctcatgctggttcgtgcccccattcctttggcaatggacggccacgcattgacggtgtaatggtcggcggcaataggggcatgacaaccagcgcaataggtatcgtcaagtttttcagcgtattgccatagcggtttacggtccgctaatgcgggatcggtaagcgcaccctgtaaagacgcctgacgccattgattgccgtattcgtcagcctgccattccccgtttacagtgagcgccttgataccttcttcacttaatgtggctagcgccagccgttgacctgccgccaggtagagcgtgttttcactgccctgcatttgataaccctgcaacagaacgatcggctgtttgccactggcatcaacgacggtgagatcggttccaggattcacggtagccagctcgcctatgtgagaagttttgaaaggataaatatgtgcgccattagtaactgaagtagcggcctgactttccagctcatgcgccgcgttgtcatccatttttatttctggcggaaaatgggcaatgcctttatgacaatcgatacaggtttcgctgtccttttgtgctttgttatgcattttctgcgcagattcactttgcgaggcaatatccatggcatcaaaagaatggcaactacggcacgttgcagagtcagtggcttttaattctttccatactgtttcggccatttcctggcgatgagcttcgaacttatcgtcactgtctattttgccgctaacaaattcatgataaatatctttagatgcctttaatttagcaaataaataatccatccctgactttggaatatggcaatcggcacattccgcacgtatccctttctggttcgaaaagtggacagttccctgatattcctcaaaaggtttactcatcgagtggcaggaaaggcaaaatgctgtatccgacgttttatgtaagactttttgcgccagcaataacccgccgccaccaaccacaaccgctatcagcaaaaacaataacccaatgcgttttttccctcgcatagattcctctaattaaattactggacaccgaaatcattgtataattaaatatacaacgaattaaccgcttgcataattaggcacaacactgcctgaaacaatcgataaagaatatgatttattacaatgtaatcattaattgctaaggaataacccagttgctatttagaatatatatttatcagttttagtaatttaaatcccataattaatgtgaatatatacaatatttttagcacaacgctatgcgcactgtcacccgctcaacagatcacggttatcgttcgttttttatactgttcagggataaaaaaaggcccctgttgaaattgcaggggcctggtacgagcaagcatcatattgggcgacatgatgcaacggtaaaaatcatttggcctgatggcgttcaatgattcctttcatttcagcaaccgccgccccgtctacgatataacgcgaatactcgtccgcgtgttcatctgatgacatggacaatccttgattacgataacgcatcggtgaggcttgccacgctcccgcggagctatggacttccagcactccggcatcgaggaagtggtgcaggttttctgcacggactcctgctccggccataatgattggagcatcacgatgggcaataagttccataatttttgataaaccttgcagtgcgtctgatttttgccctgatgtcagtacccgggcaatgcccaattccgcaagattattgagtgtatataaagggttagcgcacatatcgaaggcgcgatgaaaagtcactgccagcggaccggcagcagccattattttttccattcgtggcatatcgacattcccgtcaacatcgagaacgcccgtcaccagtccaggaaaacctaattcgcggaccgtgcgcacatcctcaagaatggcggcaaactcaccgtcgctgtagcaaaaatcaccaccgcgtgggcgaattatcggatgcacagggatcgtcacccgctggcgcacggatttcagtacacccaacgacggcgttaagcccccctcttttggggctgcgcataattcaactctgtctgcgccgttttgctgcgccgttagtgcacattccatgctgtaacagcaaatttccagtaatgccatttttactccttaattacgccgactgctcgctggcaacgatctcttcaatggaccacggatgaaacttaatagttgttttgccatcggtgaccgccagcgtcggattcggtaatcgctcatgctcaccttttggcgaactggttttcactgagatccccggtaggctgagtccttcatcagaaagcaatgccagcgcacgggcattcagcgtttctggatcacccggcagaacgatttcaatatgttcccaaccttcgtgtgggtaacgtttttccccgggccacggtagctccacaatagaaaactgccagtgcgcaacctgtaccggttcatgcaatttaaacagacaaatcggtctgccattgatcatattttctgacaaaagctcgccacactgttcaaacccgcgacgccagcgttcagcagtggcgttttgatggcaacgcaaagaaatgtgatcggcagtcagcggagtgatattcaaccccagacggcgggaaagttcatctaatgcgtggataaatcgcggtaaatccgatgcaatatcctgcagctcgtcgatagattgccagttcgccataatcactcttcgtctttcagtaaaagcgttaatttaccctgttgccctgtgccaaccaaccgctgatttcacgccgcttctgatgcaatagtgaaaacggcaatacgccacgcgcacgttgctgacgaaaacagccatttgcagtatactcccgccctaatttctttaactggtgcgggcaatttttgctcgcttcatcaatgtaaggtattccggtgaatattcaggctcttctctcagaaaaagtccgtcaggccatgattgcggcaggcgcgcctgcggattgcgaaccgcaggttcgtcagtcagcaaaagttcagttcggcgactatcaggctaacggcatgatggcagttgctaaaaaactgggtatggcaccgcgacaattagcagagcaggtgctgactcatctggatcttaacggtatcgccagcaaagttgagatcgccggtccaggctttatcaacattttccttgatccggcattcctggctgaacatgttcagcaggcgctggcgtccgatcgtctcggtgttgctacgccagaaaaacagaccattgtggttgactactctgcgccaaacgtggcgaaagagatgcatgtcggtcacctgcgctctaccattattggtgacgcagcagtgcgtactctggagttcctcggtcacaaagtgattcgcgcaaaccacgtcggcgactggggcactcagttcggtatgctgattgcatggctggaaaagcagcagcaggaaaacgccggtgaaatggagctggctgaccttgaaggtttctaccgcgatgcgaaaaagcattacgatgaagatgaagagttcgccgagcgcgcacgtaactacgtggtaaaactgcaaagcggtgacgaatatttccgcgagatgtggcgcaaactggtcgacatcaccatgacgcagaaccagatcacctacgatcgtctcaacgtgacgctgacccgtgatgacgtgatgggcgaaagcctctacaacccgatgctgccaggaattgtggcggatctcaaagccaaaggtctggcagtagaaagcgaaggggcgaccgtcgtattccttgatgagtttaaaaacaaggaaggcgaaccgatgggcgtgatcattcagaagaaagatggcggctatctctacaccaccactgatatcgcctgtgcgaaatatcgttatgaaacactgcatgccgatcgcgtgctgtattacatcgactcccgtcagcatcaacacctgatgcaggcatgggcgatcgtccgtaaagcaggctatgtaccggaatccgtaccgctggaacaccacatgttcggcatgatgctgggtaaagacggcaaaccgttcaaaacccgcgcgggtggtacagtgaaactggccgatctgctggatgaagccctggaacgtgcacgccgtctggtggcagaaaagaacccggatatgccagccgacgagctggaaaaactggctaacgcggttggtattggtgcggtgaaatatgcggatctctccaaaaaccgcaccacggactacatcttcgactgggacaacatgctggcgtttgagggtaataccgcgccatacatgcagtatgcatacacgcgtgtattgtccgtgttccgtaaagcagaaattgacgaagagcaactggctgcagctccggttatcatccgtgaagatcgtgaagcgcaactggcagctcgcctgctgcagtttgaagaaaccctcaccgtggttgcccgtgaaggcacgccgcatgtaatgtgtgcttacctgtacgatctggccggtctgttctctggcttctacgagcactgcccgatcctcagcgcagaaaacgaagaagtgcgtaacagccgtctaaaactggcacaactgacggcgaagacgctgaagctgggtctggatacgctgggtattgagactgtagagcgtatgtaatcgatttttcgtgagagtgaagcctgatcagggttagccgatcaggcttttttattgccatctaaatgtattctgaaaatggacatgccattgttttctcactgttggataagaggccagaagcgtaatatccggccccagggaaacgataacggttgaatttaaggaataccgcagtgtttaaatttcttgtattaacattaggcattatctcttgccaggcttacgcagaagatacggttatagtaaacgaccatgacatttcagccatcaaagattgttggcaaaaaaattcagatgatgatactgacgttaacgtgatcaaatcatgcctgcgacaagaatacaatctcgtcgatgcgcaattaaataaagcctatggtgaagcttatcgttatatagaacaagtgccacgcacaggtgtaaaaaaacctgataccgaacaacttaacttgcttaaaaaatcacagcgagcctggctggattttagggacaaagaatgtgaattaatcctttcaaatgaggacgttcaggatttaagtgacccttattctgaatcagaatggctctcatgtatgatcatacagaccaatacgcgaactcgccagttgcagctataccgtaactctgaagatttttatccaagccctttgacaagaggataattcacatctttttggcatgttttgttgcaagctattcctgataaataattgcaacaagacatcgagcctttttcactgagttattaaacatactcgcgagcgcgtaatttttttgtccttcagcgataattcacaatcacttcattacgttgtacctttagcggtggaattaaccgcccaccgcctggcacttcccagataaatcgcaacggttctgctgccgctataccggaaaaggccacggtggttccgctctgcccctctaattcgacacaacgagattgcgaacacaagcgaacccgcagtcctgaaggtgtcgggccgataagctgataacgccacgctaccagcgtcatcaatcctgaagcaggttgtcgcgtagaaagaggcgcagacgacatcgactcaccgcgatgatttagcgtaattcctacactacttgcctgccacatcccctccccggcggcttgcaccagcagcggaaacaataatattgctaataaggttctcattatttgccgccaattgtcgccgtcatgcggatatgtcggttatcagacagttccagattcgacaggaccactaactgcggcaagctgcggcgcaggaagcgagacaataatggtcgcagcgcgtggttcaccaacaatactggcggcgcacccagcatctcctgacgggatagcgcttcctgagtttgcgccagtaaacgatccgccagccctggctccagtcctcccccgccctgcagcgcctgtagtaacaaacgttccagcggtgtatcgaggccaataacatggacttcatctttgccaggaaaccactgctgggtaatcgcccgtcccaacgccacgcgcacgacggcggttaattcatgtggatcgctttggatgggcgcatgttccgccagcgtttcgagaatggtgcgcatatcgcgaatcggtactttttcatcgaggagattttgcagcactttatgcagtgtggtgagcgtgacgacgccaggaacgagatcttccgtcagctttggcatctcctgggcgacgcgatccaacagctgttgcgcctcctgacgaccaaacagctctgcggcatgctggctaatgaggtggttaagatgcgttgctaccaccgtgctggcctcaaccactgtgtacccctgaatctgcgcctgttcttttagcgcactttcaatccagatagcattcaggccaaatgccggatcgacggtcgcctcaccaggtaacgtcccggcagcggttccagggttaatcgccagccagcgccccggataagcatcaccactgccaatctccacgcctttcatcaaaatgcgatagcgggcaggttgcagatccatattgtcgcgaatgtgcaccactggcggcagaaatcccatctcctgggcaaatttcttgcggatactgcgtatacggcccaacaactcaccatcctgctggaaatcgaccatcgggatcagtcgataacccacttccattcccagagaatcttccagttgtacatcgttccacgtcgcttcgacaacggtattattctctgccatttttaccggtttgggttcggcaggcgctttttgttcgcgtccgcgtatccaccaggccagcccgagcaatccggcagtgaacagcaaaaataccaggttcggcattccaggcaccaggccgagtaaaccgagcacggcggcgcttaacaacataacgcttgggttactgaaaagctgattcaccatctgctcgccaacatcctgatcggtgctgacacgcgtaacgatgacccccgcggcggtagaaatcaccagcgccggaatttgtgccaccagaccgtcgccaatggtcaatagcgtataactttccgccgcgtgtcccatgctcatgccatgttgcagcacgccgaccagcaacccgccgacaatgttaatgaccatgatgaggatcccggcgatggcatcgccgcgaacaaacttacttgccccgtccattgagccgtaaaaatcggcttcctgagtcacttcggagcggcgttttttcgcctcatcttcaccaatcaatccggcgttaaggtcggcgtcaatcgccatctgcttacccggcataccatcgagaacaaagcgcgcacccacttctgcgatacgcccggcacctttggtaatgaccataaagttgatgatcacgagaatgacaaacaccacgataccgatagcgaaattgccaccaacgaggaagtgaccgaacgcttcgaccaccttccctgccgccgccgcgccggtatgcccttccattaaaatgatacgggttgaagccacgttaagtgccagacgcaacagcgtggtaaacaacagaatggtcggaaacgcagcaaactcaagcgtgcgctgggtaaacatcgccaccagcaacaccatgatcgacaaggcaatattgaaggtaaacaacaggtcgagtatgaatgcgggcagtggcagcaccatcatcgacaagatcaacaggatcaaaatcggtccggcaaggatctgccattgtgtcgatttcaggtttgcgggcaggcgcagcatcgcggccagattactcatgggtcggtttctcgttaataaaatccagggcttccggcaccggaagatgagtaggttgtacagggcgctgtccaccagccagacgccagcgtttcagttgccagacccaggccagcacttccgccaccgcggcgtacagttgacccgggatttgttgaccaatctccgcatgtcgatacagcgctcgcgccagcggcggcgcttcaagcgtcgggacgttattttcagcgccaatttcacgaatgcgcagcgcgaccagccctgcacctttagcgaccactttcggtgcgctcattttgttttcgtcatactgcaacgctaccgaatagtgggtcgggttattgacaatgacatccgctttcggcacatcggccatcatccgacgccgtgcagcagctcgctgcatctgacggatccgccctttaacatgagggtcaccttcgctttgtttgaactcatcacgaatatcctgccgtgacatacgcagctttttcaggtggctgaatatttggaaaaagacgtcaaatcccaccattggaatgacaccaagcaccaccagcagtgcgcatagccctaccaaatccatcgcattacccatggcggtaatcggagactcggccatcaagcgcatcatctgcggccagtgatgccagagaaaaaaccccgtcacgctgccaaccaggatggttttcaaaattgctttaagcaactccgcgccagtctgagccgagaacatccgtttaatgcccggtagcgggttgagtttggaaaacttcggctgcaaggatttgccgctaaataccagccctcccagcatgaccggagaaatgagcgccaccagcaccacgccgctaatcagcggcagcagcgccagcatggcttctctgatcagcagaataatctgcccgaggatcagattcgggtcattgataatactgtgatcaaaatgcagcccagcggagagcatgcccgacaatcgacgggccagcgacacaccgccaaaccagataacactaacgcccaccagcaaaatcagcagtgaggtcagttcacgggaacgcgggatttgcccctcttcccgcgctttttctagtcggtgaggtgtgggggcttctgttttgtcgtcgctctcgtcagacacgtcgccaatcctggaaagagtattaagcgtgaatgatgccagagcgcaaagcgttcaatggtttgagtaaggggcaaaacaggcgggatttagggcttttgctgccacacatcaagcatagtgtgcgtttgtcggatgcggcgtcatcgccttatcagaccgcctgatatgacgtggtcacgccacatcaggcaatacaaatcaaaatccaagactatccaacaaatcgtccacctgatcctgactggctaccacaccggctttgctggtatcgacctgaggtccattaagcaaactctggttttcacgttttggacgcgactcctgttccgggatgttttccaacagcaccatcagcaactggcgttcgatctcctgaatgacatccatcatccgcttaatgacctgcccggtgagatcctgaaaatcctgcgccatcatgatttccagcagttgcgcgttagtaaagctggtatgcgcgggtacatctgccagaaattgtcgtgtatctgttaccagttcacgggcgtcggcaaggtcaatcggatcggcaaaccagtcatcccaacgttgggttaacgcttttgctgatttctccatttgatcctgatgcggttgtgacgcctcaacactgttcagcgcccgctccgcagcctgggcggtcatctgcacaacatagtacaaacgatcgcgcgcatcggggatggcttccgccgcttcggcaatggcctgatccagccccagttcccgcaaactgtcgcgcagcatacgcgtcaggctgccgatgcgcgcaatgatatcgccagctgaatgctcgtcagcaggtttgattgatggttgcatcatagtcgcatcctcacatgcccagtttctcaaagattttgttgagtttttcctccagcgtcgcggcggtaaatggcttcaccacatagccactggcccccgcttgcgccgcagcaatgatgttctctttcttcgcttctgcagtcaccattaacactggcaatgccgacatcgcgccatccgcacgaattgttttcagcaattccaggccatccatattgggcatgttccagtcggagataacaaatccataaccgcctgcctgcaacttattgagagcgtcgacgccatcttccgcttcctcaacattattgaatcccagctctttcagcaggttacgcactatgcgtcgcatggtggaaaagtcatccacaaccaaaaatttaagttctttatccgccatttcacactcctgatttaaatacgtatcgcctgtccggcactaatttttgccaacatttgctggcttacctggctaagatcgaccacttcgcagacaccacccatattgatggcctcgcgcggcatgccgaacaccacgcaacttgcttcgttttgcgcaagggtccatgcccccgcctgacgcatcgccaacattcccgccgcgccgtcgttgcccataccggtcaggatcaccccaaccgcattacgccccgcctgtttggcgacagaatggaacaacacatctaccgaaggccgatgacggttaaccgccgggccatcgtgaattttgatttggtaatttgcgccactacgcgacagctccatatgccgatcgcccggcgcaatataggcatgccccggcaagacacgttctccgtcttcggcttctttaaccccgatctggcaaagcttattaagtctgtcggcaaaagagcgggtgaaaccgggcggcatatgctgggtaattaacagtgccgggctggaaagcggcaacggttgcagtacgtgacgaattgcctcagttccacccgttgaagcaccaatcgcaatcagtttttcagaactcaacaacggccccgccttcagcgttgtcggtgccgacaatggcttatgtgctgcaaggctcgcctttgctgccgtacgcaccttttcagcaatcatttcgttatacgccagcataccttcgcgaatacccagttgcggtttggtgacaaaatctatcgcccccagctccagcgcgcgcagcgtgacttctgaccctttgccggtcagggaagaaaccatcacaacgggcattggacgcaaacgcattaatttttcgaggaaatccagtccgtccatccgcggcatttcaacatccagcgtcagcacatcgggattgaatttcttaatcaagtcacgcgcgaccagcggatcaggcgcggtcgccaccatttccatgtcgctatggctgttgatgatttctgtcatgatctggcgcatcagtgccgaatcatcgacagataacaccctgattttgctcatcgttaatccttacttagcgcatacaccgtctgaccacgcagcgtgaagcggcgctcaaggtggctaaagttttcagagtgacccgcaaacagcaatccgtcgggtttaaggagcggaacaaagcggcgcaaaatctcctgctgggtagtttgatcgaagtagatcatgacgttacgacagaagatcgcatcaaacggccccggcacggtgtactgtttcgccagtagattcagcggggcaaaatcaacatagttcgccagctcctgacgcacgcgtaccagcccttcatgcggccccgtccctcgcatgaaataccgttgcagttgctgcggcgtcaggtttttcaactcttcatggcgatagataccgcttctggctttttccagcacttcggtgtcgatatcactggcaaacactttccagcgtccgggcgcggtgcccaatgtgtcagccagcgtcatcgcaatgctgtacggctcttcgccggtcgaagccgccgcgctccatacgcgatactcgccagaacggcgacgtgcgtgatccgcgagcagagggaaatgatgtgcctcacggaaaaatgccgtcagattcgtggtcagcgaattgataaacgcctgccactcaccgctgtgctgattagattccagcaagttcagataatgaccgaaatccgtcagtcccagcgaacgcaaacgacgaaccagtcggttgtaaaccatgtcgcgtttatggtcagccagaacgatcccggctcgttgatagatcaattgacttatccgccgaaaatgcgcgtcggaaagcgccaggcgctcggtcatctgtaacaataaagacgtttgcccacagggcagagatgaagtcatagcgccttctcaatcacttcaggataccactggcgcaatttgtaactgcaccgactcatgtcgtgctacttcatgttcttcaagggtaaataccgccacacgcgacgaaagatggtcggcctgattcgccagttgttccgttgccaccgccgcttcttctaccagcgaggcgttctgctgagtcacctgatccatctggctgacagcctgtgcaacctgctcaatcccccgctgttgttcttccgacgcagaggcaatttctcccataatgtcgttcacgcgggtcaccgaactgacaatatcgatcatggtcgcggcggcgttattcaccagtttcgaaccctgctggacacgattgactgactcttcgatcagccctttgatctcttttgctgcctgcgcgctacggctggcaagattgcgcacttcacctgccactaccgcaaaaccacgcccctgctctccggcgcgagccgcttccactgccgcattcagggccagaatattggtctggaaagcaattccgtcgataacgctgataatgtcgccaattttttgcgagctggtggcgatctcctgcatggtgtgagtcatggtactgacctgaacaccgcccgcctgcgccgttgtcgcggcattttttgccagttccgacgcctgtcgtgcgttatcggcgttttgccctaccgtggcggttaattgctccatactggcggccgtttgtgccagcgatgccgcctgctgttcggtacgacttgagagatcgttattgcctgcgacaatctccgcgataccaatgtgcatctcctggcttcccttacgcacatcacttaccgtcccacgcaaagcctgctgcatggtcttcagactggcaaaaatggcggtgatctcattacgaccatataccgcaatcggacgcgccagattacccgcagcaatgctgtcaaaatggctaccgataatggccagtggttgaacaatcatcttgcgcgtccaccacagcgcactgctgatgtagatcgccgcaacaataatcatgctgataaacaccagtgccgaaatctgatagttacgctggctttgcgcactggcggcttccagcacatggttgatctccagctgccaggcctcaaagttaacgtcaaacgcattctgtgatccctgcaccggcgcagtgaggaaatccgaaagttgattactttcaagccaggtcgcctgatgttcgagatcgttgtgccagcgggcaaaacttttctccgtctctttttgcaatcccctgacgtgctcgttgcccgcagtcatcgccataaaacttttaaacagcgtggtggattgcgtcagactggcgcgcgccgtcgtcatcaacgttttaatgtcatccgccggatagctaagtgccgtcagagtgcccgctttgttcagcgcggtactggcctgtaacattaccgcccgagtttgcgctaatgccgcacgttgctgattgctctgctcgacctgattcagtcgttgcaaatcgtcgcgaaatgcccaaaaagacatgccgttactgccaatctgcaagatcccgcagagaatcaaaattaaaaacagcgtggtcgaaattcgaatacgattaaacatcaacgctccccatcaggcggcaatgaccgcgttagtaaatactcgtcaaaatgtttcccagtttggatcttgttcagcaattcgcagtcgtggctgagccggtggttgctcactggcaggacgggatggtgtttgcggtttattggtgagtgggctggctgccagacggaacgcggaaactgcttgcgttaaacgactcgcctgttcttccagcgcagcggcggcggcagctgattcctgcaccagcgatgcgttctgttgcgtgacgcgatccatttccgaaaccgccaatgcgacttgatcgatgccacggctctgttcatccgatgccgatgcaatctcgcccataatgtcagtcacgcgagtgacagcattgacgatattgttcattgtttccccggcgctttcgaccagcaccgaaccggtatcaacgcgtgagacggagtcttcaatgagggctttgatctcttttgccgcctgggcgctgcgactggcaagattacgcacttcacccgccaccacggcaaaaccacggccctgttcacccgcacgcgcggcttcaaccgcggcattcagcgcgaggatattagtctggaaggcaataccgtcgataacgctgataatgtcggcaattttcttcgaactatcggcgatctcatgcatcgttttcactacgccatccaccactttgccgccgtgctgggcggtgtcggaggcactttgcgccagttgcgaggcctggcgggcgttatcggcgttttgcttcactgtcgcggtgagctgctccatgctggcggcagtttcttccagcgcggatgcctgctgttcagtacgggaggaaagatcggtgttgcccgccgcaatttcacgggtaccggcatagatggcatctgaaccttcgcggacatgagtgacggtgtcagtcaaagagcgttgcatatgtgaaacgctctgcgccaggtcgcccatttcactgcgcccgtcaatggtcagggtattcgccaggttaccaccggcgatttcgcgaatgtgagcaataatttttgccagcggagtaagcaacatacggcgaatgccgtaccacgccaccagcagaatcaataccaccaccagcgcgataaccgccagttgccactgggcaaatcggtaatcatctgcgttgtcagtgacgatatcgcgatacagtttttcactgctgagggcgtactgagcaaacgcttcgcccattgcattttgcattccctgggttggctgagcgaaataagctccagtattgccataatctagataatcaatcagttcagttaacgctgtgtaatagtttttatatttttcatcaatattacgactggtagcgaccatttcaggtaacggtgccatgcttttgaattttttataatgcgtcgctgcctgcgccaatgttttcctggcgctatcgagcaattcaactttggcgttactttgttgattggaggaatccatcatcatccgtaccgctgaacgactcaggttaatgcgcgtttgcagcattaaatcccaggttgacgtcagctcgccctgctgttcccgtaattgattggaaaccacaaagctcttctggctatggtgaagggaagaaaaaaacagactgccggaaataagctgtaacagtgcgaatacccccagcaccattaccaacagcgtgactacgcggatacggttaatcataaggcaccttcctgaaaacaagttgatctcgttatcggcaaggaggggggaaactttattgctgatgccacccgccgcgaaattgaaataaaaaacccgatgcgcagatcatcgggttcatttcaattgaggaaatcgggagaattacgccacttctgacgccgcgctatctaacagcgccatctcttcgctgttcagcagtttttcgatgttcaccagaatcaacatccggtcgcccagtgcgcccagtccagtgagatattctgttgaaagcgtcacggcaaattccggtgccggacgaatttgctccgccgtcaatgaaagcacgtctgagacgccgtcaaccacgatgccgaccacccgctgtccgagattcaggacgataactaccgtgttgtcgttatagtccacatccacctggctgaacttaattcgtaagtcaacaatcggcacaataacgccgcgcagattcgtgacgcctttgataaacgctggcgtgttcgcaatccgtgttacctgatcgtagccacggatctcctgcactttcaggatatcaataccgtactcttcatcaccaagggtaaataccagaaattcctggcctgacggctcgctggccagctttgttacattcgtcataccggtcatattgttacctttttactcattcaggcggcggtgttcgccatacgttgttcgcggtttatcgcctgcaaggcggagacatcaacaatcagtgccacgctgccgtcgccaagaatggtcgcagcagaaatgccggggactttgcgatagttactttcaaggtttttaaccacaacctggtgttgaccaattaattgatccaccagcaaggcgtagcggcgaccgccactttgtaagatcaccacaattccctgggtggcttcggttttcgcgcccgcgacgttgaacactttccacagttcgacgatgggcagatattcaccccgcacttccagcacccgctcgccgccggccagtggatggagatcggcttcacggggttgcagtgattccataacagcattcagcggcagaatgaaaacttcatccgcaacgcgtacggacatgccgtcgaggatggccagcgtcagcggcagtaaaatgcggatcgtagtgccagtaccctgcttcgactggatttcgacatgaccgcccatcttctggatattacgtttaacgacgtccatgccgacgccgcgcccggagacgtcggtgacctgctctgccgtggagaagccaggtgcaaatatcagcatcgcgacttcgtcgtcgctcatgttttcgctgacagtcaaaccttgcgaggccgcttttgccagaattcgctcacggtttagccccgccccatcgtcggtcacttcaatgcaaatgttgccgccctgatgttcggcagacagaattaaatttccgacgctgtttttacctgcggcgagccgtttttctggcagttcaataccgtgatcgaggctattgcgtaccaggtgggtcagcgggtcgataatgcgttctatcaggcttttgtcgagttcagtagaactgcccaccagcgtcagttctacctgcttgccgagttttcccgccagatcacgcaccagccggggatagcgactaaaaacatattccatcggcatcatgcgaatcgacatcactgattcctgcaaatcacgggcgttacgttgtaactgccccatgctggttatcaaatcaccatgattaaccgggtccagttcgctggaacgctgggcaagcatggactgggtgataaccagctcgccgacgaggttaattaattgatcaaccttttctaccgctacacggatgctggtggattcattgctgcgcgtcgttttttcccgctccacgcggccggttggcgcttgttcggctgccagtttaagcactggtggggtggatatttttggcgagacttctactgtttcaaaggtaatctgatcggcttcaatcacaaaacagagtaccgctgtgatgtcatcttcggcgatgtcgcccggtaatattgccgagagcgaatccgcccctttcaccacgtcagttaacgttgtcagatgtcccagttcttcttccagcaggtcgacttccccggccttcaggcgcgaaaggataattcgtcgcggcgactgactgcgactctgctcatcttgcggttcacttttggcaaccacacttaatcgggtcactgcggatggcgtttcgcctttcgcttctaatgccagttgacgcaaggcctggcagatataatcgaagctggcggcatccggctcttgcgactgtttataagcgtcgagctgttcttgcatgatgtccttcgtttccaaaaacagattgataatgtcggtgttgagttgcatctcacctcgtctggcttcatcgagcaggttttccatcagatgcgtggtttcctgcaaaacgctgaagccaaaagttcctgcccctcctttgatcgagtgggcagcccgaaagatggcattcaattgttcggcatctggcgcttccggctgcaaaaccagcaaatgctgctccatgtcagccaacagttcgtccgcttcatcaaaaaatgtctgataaaaatcgcttatatccatgctcacgctgtcacctcggttcggctgatggcattgtgggaacactgacctgtggtgcaacctcaggtttttccagggcgcttactggctcattctggctttcggcgttttcatgcaaaatggcctgttcggcttgtttgttcagtaccagcaggctgatgcgacggttgacggcatcatcaggtccgcgatcgcttaagcgcatcgttgccgccatgccgacgacacgtaacactttgccgctatccaaccctccgaccatcagttcgcggcgggatgcattggcccgatcggcagaaagctcccagttgctatatcctttctcaccgctggcgtaggggaaatcatcggtatgacctgaaaggctaatacggttgggaataccgttcagtacaggcgcaatggcgcgcagaatgtcgcgcatatagggttcgacatcggcactgccggttctaaacatcgggcgattctggctatcgatgatctgaatacgtagaccttcctggaccagatcgattttgagatggggacgtaacgcccgcagtttcggatcggactctatcaactggtcgagatcaccccgcaatttccgcaatcgactttgctccatgcgttttttcagctcttcgatgttcggctgcttattcacttccccctggctttgggtgtaatcatcaccaccgccgggaattgggctttcactattagaaatgcgatcgccgcccgtaaccgcagtcgccagtggagtccggaagtactccgcaatctgaatcagctcttttgggctggagatggagatcagccacatcaccagaaaaaaggccatcatcgcagtcataaagtcggcataagcaatcttccacgatccatgtgctgccccgtggcttttggctttgcgtcgtttgacgacaataatcggatgcgcttgattcttcatgcttcctcggttgtcgtctgttgttgcggatttttcaccgcacgcacatgctcttccagttcaataaacgacggacgttcgctggaatagagcgttttgcgaccaaactcaacggcgataggcggtgcgtaaccgttcagattagaaagcagagtgactttgacgcactgcatcattttgctggtttcggcgcttttctgacgtaaaacagtcgctaatggggaaataaatccgtaagccaataaaatgccgaggaaagtccccaccatcgcatgtgcgataagcgcacccagctcggcggcaggacgatcggctgaacctaacgcgtgaacgacccccattacagccgcaacaataccaaacgccggaagtgagtccccgaccagcgccagactgttcgccgggacttctgcctcgctttcgtgcgtctcaatctcttcatccatcagagcttcgatttcgaaggtgttcatgtgaccgctgataatcaggcgcagataatcgacgataaaatcaagcatgacgctatccgcgaggatgcgtgggtagctggcgaagatctcgctctcacggggattttcaatatcacgttccagcgaaaacatccccatctgccgcgatttcgccatcaaccgataaagcagagccagcagatccatatacattgctttggtgtatttggagcgacgaaacagcaacggcagcgccttcagcgtgcctttaatcgctttgccattattgccgacgataaacgacccaatccctgcaccggcaataatcaccagttcagcgggttgatagagtgctccaaggcttccaccggtcatcaaataaccgccgaaaactgtaccgagaacaaccaggtaacctaataagataagcacgacatcatccttccactgttgaccatgacaggatgttcagtcgtcaggcgttaacgcgcgattggggcaaaaaaaagcagcggtacgtcgttaccgctgctggaatgttgcgcctcaccgtatcagttaaacagcctgtactctctgttcatccagcagttgtgggataatatcggcaggattctgggaaagtttacgtctttttactgcccgggatggcggttgacataagctgcaggcaaagctgccaacaggctggtgagcgtgggtaataaaattgccgccgcagcagttgcagctggaaagttgcagtaatccactttcaacaaaccgcaccaatgtccaggcacgggttaatgccagcagtggtccttcttctgcttgtgggcactgttcaaggtataaacggtaggctttgatcaccgcatcgacgccattacacaaaccggttttcagtaaaaactgccatgcattacagaacatcgaagcatgaacgttttgttcccaggtcataaaccagtcggttgagaatggcagcatgcctttcggcggtgggcttccgcgcagttctttataaagttttatcaggcgtccgcgacttaactgtgtttcgctttccagcatctgcaaacgagcgcccagggtgatcaattccattgccagctgaatatcccgcgcttcctgaacaatgcttttttcactcatgatcaggcccttttcttgcgcagcgcttcttcaggctgattaacatcattcagcaagcgtgttgagagcatgatgccggtatgaatttgctggagatcgtcaacgcgggaatcttgcgtcaactgagtaatcgtctggtggctgtcaaaacggaagtgacaaaccagttgattggtttctgccagcttaaccatttgcggaagagtcagtgccgctaacgttgtcgccatttcttcatttatgccgagacgaaacatagcggacgctttgtcctgaacaatcaaacgctgtgcaagtagtaaatatgacaagttgatgtcataaatgtgtttcagcaactcggaggtatgcattattcccacccagaataaccaactttatttttatgcggtttcaccgcaccccgtgatgtcgccgggaagccccggtaaaaaataattagcattagaatagttgcgataagctgcaataagcagaaccacctttttggtttaatatgtccttacaaatagaaatgggtctttacacttatctaagatttttcctaaatcgacgcaactgtactcgtcactacacgcacatacaacggaggggggctgcgattttcaataatgcgtgatgcagatcacacaaaacactcaattacttaacataaatgggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccataaatgtataagtcatacttttgttttgggtgtatttcaatctgttaaaaagtttttcgctacgctagcaagcaaaaatgaaacaggaataatcgaaatgggatgttgcgcacagtcaaaataactcaccgtaaataatcatctgctataaataatcactttcatgcaataccagataagctatttttaaacagacacttaccgcacaacaaactaattaaatacaaagaaaggcaacaatcaacttaatgttaatgaaatgttttacatatattaaccacttgtttaatgcggagaatcagtacactattttcttataattacatttgaaattatatgatcaccgggagtgattgattaattatctttactaataatcagactaatatttacctgtttgaccgagttgggattgcgtcgtttctccattaggagtaaagctttaatgtcacctgaagttcacagaataaggaacaggttatgagctatagcaatattcttgtcgctgttgcggttacaccggaaagtcagcaactgctggcaaaagcggtatctatcgccaggccagtaaagggacacatcagtttaattactctcgcttccgacccggaaatgtacaatcaattagctgcgccgatgcttgaagatttacgcagcgtgatgcatgaagaaacgcaaagctttcttgataagttaattcaggatgcggggtatcccgttgacaagacgtttattgcctacggtgagttaagcgaacatattctggaagtatgtcacaagcatcatttcgatttggtgatttgcggtaatcacaatcacagtttcttttcgcgagcatcctgctcggcgaaaagagttattgcctcaagtgaggtcgatgtgctgttagttccacttacgggagattaaccgctcctacgcaagctttggaaaggtagcaactttatcgcgctgctggctttccgcgcttcgcggaactatctgctttaggtcgctaatgaagcactcctgccagtggttaatatcgtttttcacgataacgtccagcatttctgcatgacgggaaatacgttccgccagcgacatagtcaatgcacgatccagcgcagctgcaacttcgtcacgatcgtaggggttaacaattaacgccgacgttaactcgtttgccgctcccgcaaattgcgaaagaacaagaacgcccggattggctgggtcctgagcagcaacatactcttttgctaccaggttcatcccgtcacgcagtggcgtcactaagcccacgtcagagtagcggaatattttcatcagtaatttacggtcaaaatgctgattcaaataataaagcggcgtccagcctaattgcccgtatttaccattaattcgtccagcttcattttcgagctgatgacgaatatcctgataggcttgcacatcaccacgcgacgttggtgcaatctgggtataacgaattttaccatgatgctgcggatatttttccagcaacgcttcataggcgagaaaacgctctggcaaacctttggaataatccagccgttcgacagaaaagatattttgtacgtttttcagttccgctttaagttgcgccagttttggcggcagtggcccggcagcctgtttggctatttctttcggttcaatgccgatcgggtagacttctgttcgaaatgctttgccccaggctgtatggctttttgcgctacgtgtcgtgacgcgggtcaggttagaaagacaatccaggaacgccagacgatcgttttctgtctggaaacccagcaaatcataatcacaaagctgttcaagcaaggtgtcatatgtcggcagcgcgttgaagatttccggtgtcgggaaaggaatatgcagaaagaaaccaatgcgattattcactccccgtttgcgtaattcatgcgcaaatggcaacaggtgataatcgtggatccagataatgtcatcgtcttgcaacagcggcagtaatttatctgccagcaacgcatttacgcgtagatagccgtcccaggcaggacgctgaaattgcaccagatcgagccgataatgaaaagcgggccagagaacggcattggagaattggttgtagtattcgtcaaggtcctgttcgctgaggttaaaagaggcccacgtaatgttaccttttttcaccttttttagcggctgatcctcattccctgtttcaccactccagccaaaccacagtccgcctgcggctttcagtgcccccagtatgccaacggcaaggccaccggcactggcggcgtgctcgtctggtggtgcaatccggttagatactacgactaaacgactcatagtcatcactcctgttattttctcttttttgttgtaatgcggtggttatcatttcaagccagctccagacatccggcacacccgccagtcgccatgatgcctgagttgcacctgtgccaatttttactgacattccgcccagtcggttaacgactgcgaagccagattcatcggttaaatcatcgcccagaaatacgggcgttcgcccgataaagggagcttcctgcataaaagctgcaattgcctcacctttactggtacctctcggtttgatctcgacaacacactttccctgctgtaacgccatttgtggccagatctgagtaatacgttgcgctaatgtcattaatgcgtcttcatgctgcggagcctgacgataatgcagcgcaaaagccatccctttcgcctccagctccgcgccgggatactgagcgatgactgtatgcagttgcacgctaatatcacgcgcaatcgcatccggcagatgaacgatatgtgttttaccattgatgtcacggcgctccgccccatgcacgcccgctaacgggaagcgataaggttttgccagtgcgtcaagctccaccattgagcgccctgatatcaatgccaatgcaccatcacttgcggttgccagtagctgtagtccttgcagaatattgtcaggcacgacgacctgatcgggatgcggtttgatttccgccagcgttccatcaagatcaaaaaaccaggcatatttcgcggatagttcaggggtttcggttaacggttctgtcacccggttctcctccttctcttttcttattgtgttgcgcagaacgcgctttacagacatgtaagtatagacagtgtgacgggggtcgccatttgcaacgaagaacagccaaccgttatggcggttggctatggtgggaaaaaacgctaaattgttgcagaaaaaagcatcagacagtgcgtttcgctttttgcttgtaacggtcgaagatcaccgctgccagcaggattaagccgcgaaccacgtactgcgcgaaaggagaaatattaagcaggttcatggcgttttccacggtgcctaaaattaagatacccgccaccacatatgagatttttccgatgccacctttcagagaaacgccacctaaaacgcaggcggagataacaatcagctcataaccaatcgacgtcattggctgcccactggtcatacgtgaagccagaataattccggctatcgctgataccaggcctgagagaacaaagataataattttggtgcgaacaaccggtacacccgccagacgcgcggcctcttcgttcccgccaatcgccagggtgttacgaccaaaggtggttttattcagcagcaaaccaaagataatcagacacgcgacggtgagccagattggcgcaggcagaccgaaccagttggcgtaaccaagggcaaagaagctttcatcttcgataccgaccgctttaccgtctgaaatgatgtacgccagacctcgaacaatctgcatcgttgccaatgtcgtgatcagagcatttattttcagtttggcgataacaaagccattgaccaggccacagagaacgcccagcaacaaccccgctgccacgccaatccacaggctttcagtcaggttaataaccaccgccgtggtgacacccgcacaggcaattacggaggcgacagaaaggtcaaagtcaccggaagcgaggcagaacaacatgccacaagccaccatccccgacatggaaattgccaggcccaaccctttcatattaatgaaggtggcaaaatttgggacaaaaatggcacaggcgataaagagcaccgcaaacaccaccagcatgccgtactgatcccagatacgcccgaagctgaatgacgacttaggtgcgccagaccccgatgtagaaacagaagacatcatactctccttactcaggcaacagcctggctgactttaggcatcgcaaggctcagtgcctgacgctcatctgcctgctcgtgtaacaattcaccggcgatttcaccttcccgcatcaccacaatccggtcggcaacgccgaggacttcaggtaagtcgctggaggcaaacagcaccgccacgccctgcgccgccagcgcataaattacgttatatatttcgtgcttagcgccaacatcaatgccgcgcgtaggttcatccagcaaaatgaccttcatctcttccgataaccagcggcccagaatggctttttgctgatttccgcctgagagattcatgatcagttgctccgcgcccggcgttttgatgttgagcgaacgaatgtggtgatcggcattgttttcttcccaaccgttgttgattacacaaccgccgagcacatgtttacgtctggcactgatgttgatattgtcgcgaacggagtgcacgggaataatgccttccgctttgcgatcttccgggcagagcatcatgcctgcggcaatggcgtggctcggtttacgaatatcgatcggctgttggtcgatataaacctgaccggcggtgatttgcgtcccgccaaacatgcctttcattaattcgctacgccccgcccctaccagaccaaacagcccaacaatttcaccactgcgaaccgccagacttattggcgtacgcacgcctggtgctttcacagcatcaagacgtaggcgctcctcgccataactacgcggttgccagccgtagatatcgccaatgtcgcgcccgaccatcgcctgcaccagcgcgtcgtggtcaacctgctgcatatcggtaaaggttttgacataacgtccatctttaaagacagtaatggcatcgctgagggcaaatatttcttccatacggtgagaaacgtataagattacccgcccctcttttcgcagttcacgaataacgcggaaaagattgtcgatttcacgggcagagagggagctggttggctcatcaaaggcgataattttggcgttacgcgccagcgctttggcgatttcaaccatctgccactgaccaatggagagatatttcagcggcgtgtccgggtcaatatccataccaagatgtttaagttgtaaacccgcctcataattcagcaatgagcgattcacaatgccgcctttatgcggcagctggccgagatagatgttttccgcgacggtcatttccggcacgagatgcagttcctggtaaataatcgccacgcccgcgttaagtgctgcggtcgtgtcggaaaaggacatttcctgcccattaatcactacagaacccgtggttggcgcatagttgccgctgaggatttttaagagagttgattttcctgcgccattttcacccatcaacgcatgaacctgaccggcatagcagtcaaaactaatatccgtcagcgccttaacgccgggaaacgttttaccgatgccgcgaaatgagagatacggggtagactgttgcataacgtctccgtgaatcactggtcgttcacaccccctctgcatcatgcagaggggaatttttccggcaaattacttaccgcctaaaccttttttctccagttcttctttaaagttgtcacgcgtgatcagtaccacgtcggtaacttcggtaaattttggcggttcaacgtcttttgctacccagttgtaaagcatttcgctggatttatagccatgtacgtccgggcttggcagcagggaaccgtagaagccggttgcctgtgctttagacagttcgctcaccgcatccacaccgttaatgccaatgccgatgatatcggccgctttaaagccctgaccttccgtcgcgcgtacgccgcccagcacggtgctgtcgttcataccgacgatcagccaatgtttaacttccggatgttgaaccagcattgagttggcagcgtcaaatgcccccgggatgtcgttagatttggtaggtacctgataaatttgtttttccgggaatccggccgctttcagcgcatccatagatcccgtagtacggcggcgggcggtatccagttcgttggcggtaatcgccatcaccgcgctttctttgacatcccagccacgtttctgcatctctttatacagttcctggccctgacgttcgccaattttagtcgccgccatcatcaccagcggaacggtatccattggcttacctttggcgttaacaaactggtcatccacggcaatgactttcatatcgtagccacgcgctttcgcgacgatggcagagccgagtttggggtccggagtacaaataacgaaaccttttgcgccactggcagccaggctgtcgatcgcgttcaatgttttttcgccatccggcacggcaatcttaataacctcaaaccctaaatccttcccggctttatcggcaaacttccattcggtctggaaccacggctcttccggttgcttcaccagaaaaccgagcttcaggttctccgccatagcggattgtgacataacggctgccagaccaatggctgccagggctttagtaaatttgtgcatggttctctccagctttagtgtcgttttgtgtagggcaaaaacgaatgacattcgttaaattaatcggaaaacaaagcattaccttttaactaaaagataagtgactgtgttgacatagttttagcgagaaattaattctccataggagagcaatatcacatcgcagaattacagtgagaacgtgcataaatttagcgggaaaagacataagggaaagccaatttgtcagacaaattgtcgaatgcacagcagattaatccataagattagcctggaaatccttgttgtctttggtacccatgcgggatgtcttctttttaaccagtcaataggccgcattacctggcgttgagtttttgaaatggtgtaataaccgcaactcaaagatgtggaaaatgcacgtcattcatttcgtcattaattatcactgtgctcattaattaacagaacacgtataatgagagccatctcgcaaaaatgaaaaaacgttttataaaatcatcacttcatcatgaattcaaattcattgattaatatcaacaagatacaaaaagcactatcattaaaattcattgcagttacattgatttcatcaatgaaatgtaaaaatatataaacttgatgatttaagcattttcttatacccgttcagacgttattcttatttcagatcatcgtcagaattgactccacgatcacatttcggaccggcagaaaggaattattctgcaaacagtaattatggtgttttgatttatcttgcacctctccacttctggatataaggatattaggtatggcaaccgctggaatgcttctcaaactcaactctcaaatgaaccgcgagttttacgcatccaatctctaccttcacctgagtaactggtgttctgaacagagtctgaacggcaccgccactttccttcgcgcccaggcacagagtaatgtgacccaaatgatgcgcatgtttaactttatgaagagtgtcggcgctacccccatcgttaaagccattgatgttcccggtgaaaaactgaactctctggaagaactgttccaaaaaacgatggaagaatacgagcaacgttctagtacgttggcacagttagccgatgaagcgaaagaactgaatgatgattcaaccgtcaatttcctgcgcgatctggaaaaagaacagcagcatgatggtctgttgctgcaaaccattcttgatgaagtgcgcagtgcgaaacttgcgggtatgtgccctgtgcagaccgaccaacatgttctgaatgtcgtgtcacaccagctgcattgatcatcatcggcgctaatgcattgcgccgatgaaggttttgagaaaccgctgcctcatctgtttgaagcagcggtttttttaatgggattcaccctgtggggtaaacttgagttcaataagcgcgatggctttttggattgcccgcatggtgaccgggtctgcggcggcgggatggttagtaaagtcgatattcttcagctgactggacattttttcacgaacttcaacgggcgcgattacatcgagaacatccagaatttgtttgataaccaactggcaagcaaccacatcagaaaccaattcctgatcggcattcagcggctgggacatcgtaaactcctgatagcattttgaaagccgttatagtagcgacttcacatcttcagcgatagtcacatccaccgtcatcaggacacaaaaaaacctgccggagcaggttttttgttatcggaacatattgcctggcggtacgtctttgaacgtcttgcaatagttattgaacatacttttcaggattttgcgcagtttcatcgcggcactccgaccatttgttatacaggtgttattgtctttgcgcttataatatgacaaccatcacaaaaatcaatctttatgtgatacaaatcacataaatacccctttaatgttataaaaatgataatcaaaaaacagcccccctatttctgacacctacagatggcaagaaatagcgcctgccaggcgtcttttccggccattgtcgcagcactgtaacgcgtaaaatagtgctttctcttactcttctggctggaccatgagacttctgattctgactctttcattaataacgctggcggggtgtacggttactcgccaagcccatgtgagcgaagttgacgcggcaacaggtattgtacggttagtttatgaccaggcttttttgcagcatgcccataccgatcgttatgtcagtcgcgggatcgccgatcgcgcatgccagcaggaaggctatacccacgcggtcccctttggtcagccagtaggcaactgtagcctttttgcgggttccttatgtttgaatacggaattcactttgtcatatcagtgccatcattccgccttccctgtctttctctaaatattttaatcagcgaggggatcttcgctgattaaagaaatagcggtaatgcgttttattcccattcgtatttttaataattgaagtttatattttaccttttgcaaataataaaataacaaattatagtgacgccacagcaacaaatataacctttgtggagcactatcatgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaatgctctccggcggcaggtttactgccgccgtttcaaatcagtgacggcaaatcttactctgatcggtcgaaaaaccgtctttcgaaggtataaatttgccttttgctgccagaaacgctaccagctctcccgctgtcatcccttctgccgagcaggtgtgaaaacgtgcctgttcaccaaaacgcgctttaatcgcagcttccagactggcatgcgtatattgctcgcctgattcaatcatcatatttaacacttcatgaccgtgaatagagtccatcgtccctcctcaaaaaaagcctagcgtagcgattgccgcttatgaagactttgcgccagcgcaggactgaatgctttttattgtacatttatatttacaccatatgtaacgtcggtttgacgaagcagccgttatgccttaacctgcgccgcagatatcactcataaagatcgtcaggacagaagaaagcgtgaaaaacagaaccctgggaagtgtttttatcgtggcgggaaccacaattggcgcaggcatgctggcaatgccgctggctgcggccggtgttggttttagcgttacgttaatcttgttgattgggctttgggcgttgatgtgctacacggcgctattactgctggaggtgtaccagcatgttccggcagataccggtctgggcacgctggcaaaacgctatctgggacgctacggtcaatggctgacgggcttcagtatgatgttcttaatgtatgctctgactgcggcatacatcagcggtgccggtgaattgttggcctccagcatcagcgactggacaggtatttctatgtcggcaaccgctggcgtgctgttgttcacttttgttgccggtggcgtggtttgtgtcggaacttcactggtcgatttatttaaccgttttctgttcagcgccaagattatttttctggtggtaatgctggtactactgctgccgcatattcacaaagtgaatcttttaaccctgccgttgcaacaggggctggctctgtctgcaatcccggtgatttttacgtcgtttggttttcacggtagcgtgccgagtattgtcagctatatggatggcaacattcgtaagctacgctgggtgtttataatcggtagtgcgatccccctggtggcatatattttctggcaggtggcgacgcttggcagcattgattcaacaacctttatgggattgctggctaatcatgctggattaaacgggctgttacaggcgttacgcgaaatggtggcctctccgcatgttgagctggcagtgcatttatttgctgatttagccctcgccacgtcatttctcggcgttgcgttaggcttatttgattatctggctgatttatttcagcgttcaaataccgttggtggacggttgcaaactggtgcaattacgtttctgccgccgttggcgtttgcactgttttatccacgaggatttgtgatggcgctgggttacgccggtgtggcgctggcggtactggcattgattatcccttcgctgttgacctggcaaagcagaaagcacaatcctcaggcgggttaccgggtcaaaggtggtcgtccggcgctggtggtggtgtttctctgtggtattgctgtgattggcgtgcaatttttgattgcggcagggttgttaccagaagtggggtgatcagatagcctcaaattccttattgggtgccagaattaacgctgacacccaatttggcctcttaatgcaggcagcactgcttaaatttcttaccactaccgcacgggcaaggatcgttacgccccggtttctcttctgctttgatcggttgctgaacagctttttcctgcggatgcgccatccagtacgcatgtagatcaagcgccgccagtcgaatggcatctacgctctcttcaaacgcttctggcgacatcttttctacccgctcgaagttttcctcagtaccgtgcagcgcaatcgcctccagcgctggttttaacgaatcgggcaacgttgaccagtcagaaagtgccacgccccgcatatagccaaagcaccactcctcaacaatcgtcagctcgctgccatcaacttctcgcaagccgaataacggctcaaactgctccgggaattcgttcagacgctctgcggtatcggccatatgttgaaaagccagattcataaagcgcgtcatctctttctctgacgcccagcgcggcacatagtcagccccaccccacacggcaaccagccactgttccggttcaatctcttgcggagaactcaacaccgccgtcaataaaccgtccagctccgccacatcaaggatggcgtggtcagtgttgtatttggtcagaatatcgtccagccattccaactcactttcgtttaacggtcccgttttcatacgcttttccttgtggatctcaactcgccagcacctatcttacatgccggtccgtatcagagatactttttgagtggctttgctggtgattaaaaattaaggagggtgtaacgacaagttgcaggcacaaaaaaaccacccgaaggtggtttcacgacactgcttattgctttgattttattcttatctttcccatggtacccggagcgggacttgaacccgcacagcgcgaacgccgagggattttaaatcccttgtgtctaccgattccaccatccgggctcgggaagaaagtggaggcgcgttccggagtcgaaccggactagacggatttgcaatccgctacataaccgctttgttaacgcgccaaattcttcaggcctttcagccagacatccgcttgacgccgatgtcttttaaactggagcgggaaacgagactcgaactcgcgaccccgaccttggcaaggtcgtgctctaccaactgagctattcccgcattcatcaagcaatcagttaatcacttgattttattatcgtctggcaatcagtgccgccgttcgatgcgttgcattctacttacctggcgcgatgagtcaacgatatttttcaccacttttgatcgtttgctgaaaattacgccgaaacgatcactgatcaagcaaatctgcacgcgcagcgctcaaatattgcaacattgaccacagagtcagtaccgcagccacaaagaaaagtgcaataccggcgtactcaacccaaatgttcggacgccacagcagccatgccaacgccaccatctgggcagtggttttcactttcccaatccaggagacggccacgctactgcgtttacccaactccgccatccattcgcgtagcgcagaaataataatttcacgggcgatcatcgttgccgccggtaatgtcacccaccagctgtgataatgctcggttaccagcaccatggcgatagccacgagaactttatctgccacagggtcaaggaaagcaccaaaccgggtactctggttccagcggcgtgccagaaaaccatcgaaccagtcagtcaccgccgcgacgcagaaaatgagcgcggcggcaaacggcgaccaggtgacaggcagataaaagaccaatacaaagaatgggataaggatgacacggaacagtgtaagcaacgtagggatattaaattgcataatgacgggtaactatctgttgtcagtaagattacccctatgttgctacagagacatcaatgtttcaacgaccagaagatcttttctgccagaccttgcgaaatacccggcacttttgcaatttcctcgacgctggcgttacgtaaaccttgcaaaccgcccatatatttcaacaacatttgccgacgttttggcccgacgccttcaatggtttccagggaactggtatttttgaccttcgcccgttttttacggtgcccgccaatcgcgtgatcatgtgattcatcgcgaatatgctggataacatgcagcgcgggtgaatctggcggcaaactaaatccctcaccttccggctcaaagaacagcgtttccagtccagccttacgatctgctcctttggcaacgccaagtagcagcggatgatttttatcccatgagacatccagttcggcgaagacatttttcgcctgcgcaagctggcctttgccgccgtcgataaggatcacatccgggatcttactgtcgtcaatggctttaccataacgccgacgcagcacctgattcatcgccgcataatcatcgcccggcgtgatgcctgtaatgttatagcgccgatactccgcacgcagcgggccgttagcatcaaacaccacacaggaagcgacggtttgttcgcccatggtatggctgatgtcaaagcactccatccgcttcacttccggcaatttcaacacgctggcaagcgcggtcagtcgctggtgaacggtagattgctgcgaaagtttgctggttaaggccgtcgccgcattggtgcgcgcgagtttcagataacgcgccctatcgccgcgaggtttggtttgaacattaatcttgcgtcccgccagttctgaaagggaatcggcgagcagcgttttatcgctaagattaaaatcgagcaggatctcacccggtaaggtgcgcatctggctgccttgtaaatagaactggcctacgaaggtttctaccacctcgctcagttccgtaccgccaggcactttcgggaaatagctgcggctgccgagcactttgccctgacgaatgaacaatacgtggacacaagccatgcccgcatcgaacgccacaccaataacgtcgaggtcgtcgccggtattggaaacgaattgtttttcggtgacgcgtcgcaccgcctgaatttggtcgcgaatacgtgcagcttcttcaaactccagattctggctggcagtttccatacgactaatgagttgcgtaagcacctgatcatctttgccagacaaaaacaggcgcacatactcgacctgctgagcgtattcttcttcactcaccagtccttcaacgcacggtcccagacagcgccctatctggtattgcagacacggacgcgagcgattgcgataaacactattttcgcactggcgaatggggaaaatcttttgcagtagcgccagtgtttcacgtacggcatagccattcgggaacgggccgaaatattcacctttggcatgcttcgcaccacgatgcatcgccagacgcgggtgggtatcaccactcaggaagataaaaggatatgatttatcatcgcgtagcaaaacgttgtaacgcggctgatagagtttgatgtagttgtgttccagcaacagcgcttcggtttctgtgtgagtaaccgttacatcaatttgctggatctgggcgaccagcgcttcggttttgcgcgaagcgaggttgctacggaaatagctggaaagccgttttttcaggtctttcgctttgccgacatagataaccgtaccaccagcatcgtacatgcgataaacgcctggctggctggttacggtttttaaaaacgcttttgcgtcaaactgatcactcactgacttgataatgtctccgcattacacagaccatggcgaattgccaggtgagtcagctcaacatcgccatgaatgtttagtttactgaacatacgatagcggtagctgttcaccgttttcggactgagattgagctgttctgagatctcattgaccttctggcccttggtgatcatcagcataatctgcaattcacgttcagacaaactggcaaatgggctttctgttttttctggttcgatctggcttaacgccatttgttgagcgatgtcagaagcaatgtaacgctgccctgaatagacagaacgaatcgcactcacgacttcctgcggagccgcgcctttgctgaggtagcccgcagcaccggcctgcatgactttcgctggtaaagggttttctgtatggacggtaagcatgatgattttgacatcagctgtggaacgcgcgattttacgcgtcgcctcaagaccgccaatgcccggcatactcatgtccattagcaccacgtcaacggcatttgtccggcaccacttaacggcgtcttcaccgcacgatgcctcaccgacgacttttataccctttatatcttccagaatgcgtcgtatccctgcgcgcaccagttcgtggtcatcaacaagtagaacgttgatcaaaggaatatctccagaaatagggataacgctactgatagttagtcattcgtatattagcggtttttattgcaactttgaaacgttaaaaatggtgggtattcgatttttctctcgtttttgtcaattcgattgtccacagttatggtcacgcccgtcaccaacggcttaccggatcgtttcacagtaagccctacgatgaaatgtgacaaaaattgactttattcagcaaaaatgaaaatcagcccgctgaatatgtaacattaattaacccgaacaatacgggcaaaaaacattcatgataaaaatatttattggtcattatattaacgtattttatagcactgccgatatcacgctcaaaaaacaaccactgctatttttagcaaagcttatggtatactccgccgccttaacatttttcaccgcaaattttcattgcaacatgacgaggaaaataaatgagtacgcctgatttttctactgccgagaataatcaagaactggcaaatgaagtctcctgcctgaaagcgatgctgacgctgatgctgcaggcgatgggacaagctgacgcgggccgcgtgatgttaaagatggaaaaacagcttgcgctgatcgaagacgaaacccaggctgcagtattttccaaaacggttaagcaaattaaacaagcctaccgtcagtaatataaaaccggctgatagcgtgcctttcagccggtttttgcatctggcacgcaggacagaaaagagatcaaattaagccagtagcggccgcgtaacaggcaacctgggtcttatttggtgcattaatttttttctgcatgtttttctggtggaaattgaccgtattctcagagattgacaaaatcatcgctatctctgctgatgttttcccttccgccgtccacctcagaatttctttttcgcgcttgctgaaattcatctctggcgtcatcactatttcatcatttaaacgcatcagagccatcagactttcgcgcaccagtaactgcatttttaattgcagttcatcactaagaatgggtatttcgcgcgcgctgcaacgggaaaaggacaaaaagcccagcgcccggtttggcagcattaaatactgagtgacaccgcggcgtaaaccatgtgcgcgcgcggcttcccataacggctgtgcttcgctgaataagtcatcattccacattaaatggccctgactaaagttttcagggttcagcaccggatcaattgcgagaaagttttttgcctgataataactaacccacgcctcagggtaattggtgtaaaaagccactttaggtcgagtgaatggtaccgggtggcggacacataacgaatagtaatcgtactccagctgctgagcctgaagctcaatttcatggtagacctcttctgcggtctccatcctctgaaaacgcaacagcatcgtgcgacgccagctgaaaaaatccttatcctgcatagtaaaccgcaacgcccctgagagtgagtatcatttataatgataattcaaactatcacataaataagatttatatataatttatattattcaggcaatgaattacttttgcaagccatcgcattctcttatgttattaatgagttatgctgatttgttaagcagttttatcaggcttgaaatggcgtccagccccgacaggtgaatcgtcggggctgattttttcttattattgcagcagaaacttctcgaggaactggcgggtgcgaggctgctcggggtcggcaaataacgcttttgcggccccctgctcgactatccgcccctggtccataaagatcgcccggtccgcaacatcccgggcaaagctcatttcgtgcgtcacaatcaccatcgtgcgcttttcctgcgccagctgacggatggtgttcaggacttcacccaccagctctggatccagcgctgacgttggctcgtcaaacaaaatcacctcaggacgcattgccagcgcacgcgcaatcgcaacacgctgctgttgaccgccagacaaacgacgtggatagctggtttctttacctgccagcccaacttttgccagcagctcgcgagcgcgcgccgtggcctcttctttcggttcacctttgacgatcaccggcccttcaataatgttctccagcaccgtacgatgcggaaacaaattaaagttctggaagacaaacccgacgtgctgacgcaactggcgaatcagagatttttgctgacttaatgaacgtgcagtatcaatagtgatatcgccaacggtgatcgttcccgcttcgggttgttccagcagatttatgctgcgtagcaacgtggttttgccggaaccactcggaccgataattgccaccacttcgccaggctttacctcaaggtcgataccgtgcagcaccgtctgaccgtggaattttttcaccaggttcttaacttcaatggcactcattttggttctctctcctggcgattaagttgattctcaaaatggttctgcaacgtcgataacacagtcgccatgatccagtagatgagcgaagccgccagatacatggtgaacacctccagcgtacgcgaggtaatcaactgcgcctgacggaacagctccggcacctggattgtcgcggccagcgacgtatcttttaccaggctaataaagctgttcgacagcggcggcaacgccacacgcgccgcctgtggcaaaatcgcgcgacgcatggtctgccacggcgtcataccaatactggctgccgcttcccactgacctttatcaatagaagaaatggcggcgcgcagcgtttcggcagcataggcggcagtgttcaacgacagaccaatcattgctgacggaatgggatctaattcgataccaaactgcggcaggccgtaatagatcataaacagttgtgcgatgagcggcgtaccacgaaaaatagagatataaaaacgcgccagccagcgcacgggccagattggcgacagacgcatcagcgcgagaataaacccgagcagtaagccaaaaaacatgccgccgatactgagttgcagcgtatacccagcccctttcagcaggaacggcaaggaatcaataaccagttgtatactttcttgcatgagcgtttccggagctaaacgtggggatgataggcgaacagcgcaggcgcaccgccggtatgaataaacagaatcggcccttcatctttgaagcgtttctgactgataccgtcaatcagccccgccatcgcttttccggtatacacaggatcaagcagaatgccttccagccgcgccagcaatttcactgcttccatgccttcgtcgttcggcacgccgtagccaggtgcaaaatagtcatcccagagtaaaatttccgctgatgcggtcagctccagttctttcgcaatcgcctgttgtaggttaaccactttcggcaattgatcggcaacggaacgcgacacggtcacgccaatcagttcgctttcaggcatcaggtgttccagcccaacagccagtccggcgtgagttccggcactgcccgatgcgactaccaccgatgaaatattaaccgccccttcacactgttgcgcgatttccagcgcactctccacataacctagcgcgccaagagcattagaaccgccaaccggaatgacatacgggcgaaagccttgtgcttcgactcgcgtcgccagctcttccagttgggcattgggatcggtcagtgcgtcgcacatttcaatctgggtattgaacagatccagcaacaagcgattgccgttggttaaatagttttctgcggttgtgccaataggattttccagcagcgccacgcagtgcagaccgagtttggcagcgactgcggcagtctgccgcacatggttagactggatcgccccggcagtaatcagcgtatcggcaccttcacgcagagcatctgccgcgagaaattccagcttacgtaatttattgccgcccattgccatgggggtgacgtcatcccgtttgatgaaaatttcccgtcctagataatcagaaaagcgcggcagatattcgagcggcgttggcgcgccgataaactccagccgtggaaaacgggttaaattatgcagtggcataacagcctccgatgtgtgttgttgtgattttcttattatgcacgctgaaaacgcgtaaataaaaaaggcgctagtgaaagcgcccttttttgtcattatgctgattatttggtcacatcagcaccaaaccatttttcggaaagggcttgcagagtgccatctttttgcatttccgcaattgcatcattcactgctttcagcaggtcctcatttcctttacgcagcgccacgccagactcctgacgggagaatgcttcaccggttactgccagcgtatcgttggttttcttcaccagatccagcgccgccagacgatcaacgaggatcgcatcgatacgccctacgcgcagatcctgatatttggtcgggtcatcatcataggtacgcacatcgacgccctgaacattctgccgcagccactcttcatagttggtgcccagaccgacccccacttttttgcctttcagatcatcggctgttttaatggtgccttcgttaccttttttcaccagcgcctgaataccagaaatggtgtacggggttgagaaatcgtattttttcttgcgctcatcagaaatggtgacctgattaatcaccacatcaatacgtttagagtccagcgacgccagcataccgtcccatttggtcggttttagtgacgcctcaacgccaagatgttttgccagctgttgggcaaattccacttcaaaaccggttaatttgccgtcatctccctgaaaactgaacggcggataagttccttccagccctaccagcagcgtgccgcgctctttaactttattaagcagaccttcatctgcaaaacttttaacgctcatgcccgcaaccagcgccacggccatcacacccatcaatgcctgacgtcccagatgtgctaatttcatattcaccccgaatgttgttatgtctgtttgcagtgtagagccattgtttgtaaacacaaaaacaactccgctacatcttattcttatttaatatatatcagaagaaggcaggctggaggatttctgcacaagtctggtacaggtttggcgctgatagtgttgatacttccgtaacgcgatgcggtaattgttggtgctggtggtgggcagccacggggcgaggatttcatcaaggaaaccgtcctgcagctgatcgagggaaatattttgctcgtgtagatgattccccaaacggcgcaaacgaacgacatattcacgcaccgtacctgggctcatttcagtttgctcaaaaagaaattgcttaaagccgataatatcgaaaaaatcactctgcgttttgcaatgtaaatcaccgcaaaatcggcacaatgccgcccatgatttttgttccgtttgccagccattttcatcaagcagcgtgtccaggcgggaaatctcgattttattcactattttgccgtcgcgaactaaggtaatgcgatcgagtaatttacggcaatgcgcgcaatgggtctggctgtgtttaaagtctttaagatagcggcttaatggccgtcttttcaggtgctgcaccatcattaagaactcctggtagtcaaagttaaagtgcggcatttactgacgttataacttacccagtttagtgcgtaaccgtttaatagcctggctgtgtaactgactgacccgcgattccccgacctccagcaccgcgccaatctctttgagattcagctcttcctggtaatagagggttaataccagtttttcgcgctccggcaacgtttcgatggcttccatcacccgctggcgcagattactgtccagtagttgttgtagcgggttttctcgctgatgatcatcagtaaccagttcgatgctatcgccgtgctcttcgcgccactcatcgtaggagaagagctggctgttattggtgtcgagcaacatttggcgataatcggcaatatcgatccctaaacgttccgctacctcagtttccgtggcgttgcggccaagttcctgctccagttgccctattgcctgtgccacttcacgcgcgttgcgtcgcacgctgcgcggcacccagtcacggctgcgaagttcatccagcatagcgccacggatacgctgcactgcgtaagttgtaaatgccgttccttgtagggcgtcatagcgttcgacggcattaagtaacccaatgccgcccgcctgtagcagatcgtcaagttccacgctcgcgggcagtcgaacctgcaggcgcaatgcttcgtgacgcaccagcgggacataacgctgccacagcgagtgtttatccattacaccttcagcggtatagagtgaattcacgataaacagccctgcgttatatgagttatcggcatgattatccgtttctgcagggtttttaatcggacgattagtgggtgaaatgaggggttatttgggggttacaggtaaattccaggcagaaaaaaaccccgccggtggcggggaagcacgttgctgacaaattgcgctttatgttgccggatgcggcgtaaacgccttatccggcctacaaaaatgtgcaaattcaataaattgcaattcaacttgtaggcctgataagcgcagcgcatcaggcaatttggcgttgccgtcagtctcagttaatcaggttacaacgattaaccctgcagcagagacagaacctgctgcggtacctggttagcttttgccaacacggagttaccggcctgctggatgatctgcgctttcgacatattggacacttcggtcgcatagtcggcgtcctgaatacgggactgcgcttcagacaggttggtagtggtgttgttcaggttggtaaccgcggaatccagacggttttgcaccgcaccgagggaagaacggaatttgtctacagatgcgatagcatcgtccagcgctttcagcggatccgtggttttaccatttgcaacagcagtcagagcctcaccaccagcagtcaaacctgtttgcagattaccgccatttaaatcggcagaatcgtatgttttaccatcaatatcgaccacttctgttttgccatcatctccgcccagtttgaccgcggttggagaactggcggcaccggaagagtcagtataggtaatagttttaacagaaacagcaccagtagtttcattcacatccgcagcgtaaagattgccatttgtatctttaagcgcatatgtatcggtatcattacccttggaatcctgcagttttactaagctaacagcaccaaggttggcagttgcggaacctgcagtattatcaatctgaacaggtgtaccgcctgaagtgatagttgtagctttagtagtatttgcatcagttacagttgcatttgccgttgctccagtcgccattgtcactgtaccatcattagcaactgttactgcgtaatacttcccatcgttatcaccaccggtgattttcgcatagtaatcattaccattatcagtataaacaccctcaattgaagctgggttagttccgccagtatcagtggctgcttccgtagaaagggtaattccagtaagtttaatattgtttgtggtggtagcaccaaaagcagttactggagcactagtggtaactgtatcgttatttttaacgctaaaaccatcaaggccaagagttttagcatcaatctgcttcagatcgatagtgatagtctggttatcatttgcgccaacctggattttcatggagccattttttgccagcacgttcacgccgttgaactgggtctgaccagatacgcggtcaatttcatccagacgggatttaatttcgtcctggatagaagacagatcagactcagagttagtaccggtagtggcctgtaccgtcagttcacgcacacgctgtaagttgttgttgatttcggacagcgcgccttcggtggtctgcgcaacggagataccgtcgttggcgttacgggccgcctgagtcaggcctttaatgttagaggtgaaacggttagcaatcgcctgacccgctgcgtcatccttcgcgctgttaatacgcaagccagaagacagacgctcgatagaactcgacagcgcagactggttcttgttgatattattttgagtgatcagcgagaggctgttggtattaatgacttgtgccatgattcgttatcctatattgcaagtcgttgattacgtattgggtttccacccgtcggctcaatcgccgtcaaccctgttatcgtctgtcgtaaaacaacctttagaatttttttcaaaaacagccattttttgttagtcgccgaaatactcttttctctgccccttattcccgctattaaaaaaaacaattaaacgtaaactttgcgcaattcagaccgataaccccggtattcgttttacgtgtcgaaagataaaaggaaatcgcatggcaagtatttcatcgctgggagtcgggtcaggtctggatttaagttccatccttgatagcctcaccgccgcgcaaaaagcgacgctaacccccatttcaaatcagcaatcgtcgtttaccgctaaacttagcgcctacggtacgctgaaaagcgcgctgacgactttccagaccgccaatactgcattgtctaaagccgatcttttttccgccaccagcaccaccagcagcaccaccgcgttcagtgccaccactgcgggtaacgccatcgccgggaaatacaccatcagcgtcacccatctggcgcaggcgcaaaccctgaccacgcgcaccaccagagacgatacgaaaacggcgatcgccaccagcgacagtaaactcaccattcaacaaggcggcgacaaagatccgattaccattgatatcagcgcggctaactcatcgttaagcgggatccgtgatgccatcaacaacgcaaaagcaggcgtaagcgcaagcatcattaacgtgggtaacggtgaatatcgtctgtcagtcacatcaaatgacaccggccttgataatgcgatgacactctcggtcagcggtgatgatgcgctacaaagttttatgggctatgacgccagtgccagcagcaacggtatggaggtctcggttgccgcccagaatgcgcagctgacagtcaacaacgtcgccatcgagaacagcagcaacaccatcagcgacgcgctggaaaacatcaccctgaacctgaacgatgtcaccacgggcaaccagacgctaaccatcactcaggacacctccaaagcgcaaacggcgattaaagactgggtgaatgcctacaactcgctaatagataccttcagcagcctgaccaaatacaccgccgtagatgcgggagctgatagccagagttctagcaatggtgcactgctcggcgactccacgctgcggacgattcagacgcagttgaaatcgatgctgagtaataccgtcagttcttccagctataaaacgttggcgcagattggtatcacgaccgatcccagcgatggcaaactggaactggatgccgacaaactcaccgctgcactgaaaaaagatgccagcggcgtaggtgcattgattgttggcgatggtaaaaaaaccggcatcacgaccaccatcggcagcaacctgaccagttggctttcgacaacgggcattattaaagccgctaccgatggcgttagtaagaccctgaataaattaactaaagactacaacgccgccagcgatcgcattgatgcgcaggtcgctcgctacaaagaacaatttacccaactggacgttttaatgacctcgttaaacagcaccagcagctacttaacgcagcagttcgaaaacaacagtaattccaagtaagcaatattcatcgggagacaggtcatgtacgcggcaaaaggcacccaggcctatgcacaaattggcgtcgaaagcgccgtaatgagcgccagccagcagcagctggtcaccatgctatttgatggagtgctgagcgcactggttagagcgagcctgtttatgcaggacaacaatcagcaaggcaaaggcgtctctttgtcaaaagcgatcaacatcattgagaacggactgcgggtgagtcttgatgaagagagcaaagacgaactaacccaaaacttgattgctctttatagctatatggtcaggcgcttgctgcaagccaatttacgcaacgatgtctccgcagtcgaagaagtggaagcattaatgcgcaatattgccgatgcctggaaagagtcgttactctccccttctttgattcaggacccagtctgatgaaccatgcaccgcatttatatttcgcctggcaacaactcgtcgaaaaaagccagctcatgttacgcctggcaacggaagaacaatgggacgaactcatcgccagcgaaatggcgtatgtgaatgcggtgcaggagattgcacatttgactgaagaggttgacccgtccaccacgatgcaggagcagctccgcccgatgctgcgcctgattctcgacaacgaaagcaaggtaaagcagttattacagattcggatggatgaactggcgaaactggtcggtcagtcatcggtgcaaaaatcggtgttaagtgcctatggcgatcagggcggctttgtgctggctccgcaggataacctcttttgaatctgaatgagtcgatggctcgcgaataatccgattacggctacgcttctaatgttccccttgaatggagtcgaagaatgcgtaatcccacgctgttacaatgttttcactggtattacccggaaggcggtaagctctggcctgaactggccgagcgcgccgacggttttaatgatattggtatcaatatggtctggttgccgcccgcctataaaggcgcatcgggcgggtattcggtcggctacgactcctatgatttatttgatttaggcgagtttgatcagaaaggcagcatccctactaaatatggcgataaagcacaactgctggccgccattgatgctctgaaacgtaatgacattgcggtgctgttggatgtggtagtcaaccacaaaatgggcgcggatgaaaaagaagctattcgcgtgcagcgtgtaaatgctgatgaccgtacgcaaattgacgaagaaatcattgagtgtgaaggctggacgcgttacaccttccccgcccgtgccgggcaatactcgcagtttatctgggatttcaaatgttttagcggtatcgaccatatcgaaaaccctgacgaagatggcatttttaaaattgttaacgactacaccggcgaaggctggaacgatcaggttgatgatgaattaggtaatttcgattatctgatgggcgagaatatcgattttcgcaatcatgccgtgacggaagagattaaatactgggcgcgctgggtgatggaacaaacgcaatgcgacggttttcgtcttgatgcggtcaaacatattccagcctggttttataaagagtggatcgaacacgtacaggaagttgcgccaaagccgctgtttattgtggcggagtactggtcgcatgaagttgataagctgcaaacgtatattgatcaggtggaaggcaaaaccatgctgtttgatgcgccgctgcagatgaaattccatgaagcatcgcgcatggggcgcgactacgacatgacgcagattttcacgggtacattagtggaagccgatcctttccacgccgtgacgctcgttgccaatcacgacacccaaccgttgcaagccctcgaagcgccggtcgaaccgtggtttaaaccgctggcgtatgccttaattttgttgcgggaaaatggcgttccttcggtattctatccggacctctacggtgcgcattacgaagatgtcggtggtgacgggcaaacctatccgatagatatgccaataatcgaacagcttgatgagttaattctcgcccgtcagcgtttcgcccacggtgtacagacgttatttttcgaccatccgaactgcattgcctttagccgcagtggcaccgacgaatttcccggctgcgtggtggtcatgtcgaacggggatgatggcgaaaaaaccattcatctgggagagaattacggcaataaaacctggcgtgattttctggggaaccggcaagagagagtagtgaccgacgaaaacggcgaagcaaccttcttttgcaacggcggcagcgtcagcgtgtgggttatcgaagaggtgatttaaattcatccccggcggcaagccggggagatttcattacggcagtggcgtcggtaacggcgctttatccagcgcggcggcacactctgctgtcgggcgatccacacgctccatcgtcataccatcgtactcaatggtgttaccgtcacgctcaacctcgtacagctcacgttttacggtaacgttagtgagatcatcagacatcaatgtcaacttacccggcacggcaatcacccgctgccactgacggcaatccagggtatcgccctctttagtgacaatcaggctgcctatcgcttccgggctgaccagcgcacgttgcggccctttggtctgccagtagcccgccagccagtccggcgcgggggttttcacgacattgttatagttttcgacttcggcacagcccgccagcaacaagagcgcgcctgcaattgcgagttttttcatcattcgtcctgcatgagaagaaaagaggattgtggcattaaagccctgatgtcgccagcctttcaaggttcagagagaaatttgatctaactattatttttgtgaattattaccccgaaaataaatttgcatggtgtatgattcgcgactcttgtttcaaaccttctgagttcagaggctacattcatgtcatggcagcaattcaaacacgcctggttgattaaattctgggcccccatccctgcggtcatcgcggcgggtattctctctacttactattttggcattactggcaccttttgggctgtcacgggtgaatttacccgttggggcggccagctcctgcaactgttcggcgtccatgctgaagagtggggttactttaaaattatccatctggaaggatcgccattaacccgcatcgacgggatgatgatcctcggtatgtttggcggctgctttgccgcagcgctgtgggccaacaatgtcaaactgcgaatgccgcgcagccgtatccgcattatgcaggccatcattggcggcattatcgccggttttggcgcgcgtctggcaatgggctgtaacctggcggcgttctttaccggtattcctcagttctcgctgcatgcctggttctttgccatcgccactgccattggttcatggtttggcgcgcgctttaccctgctgcccatcttccgtattcccgtgaaaatgcagaaagtttctgccgcctcaccgctgacgcaaaaaccggatcaggcgcggcgtcgttttcgtctcgggatgctggtctttttcggcatgctgggctgggcgctgctcacagcgatgaaccaacccaaactggggctggcaatgctgtttggcgtcggctttggtttactgattgaacgtgcgcaaatctgctttacttcagcgttccgcgatatgtggatcaccggacgtacccatatggcgaaagcaatcattatcggtatggcggtgagtgccatcgggatcttcagttacgtacagttaggcgttgaacccaaaatcatgtgggcgggaccaaacgcggtaattggtggtttactgtttggttttggcatcgtgctggctggcggctgcgaaaccggctggatgtaccgcgcggtagaaggccaggtgcactactggtgggtcggtctgggcaatgtgatcggctcaacgattctggcgtattactgggatgatttcgctccggcgctggccaccgactgggacaaaatcaacctgctgaaaacctttggtccgatgggtggcctgctggtgacatatttgctgttgtttgctgcgctgatgttgattatcggctgggaaaaacgcttcttccgccgtgcggcaccgcagactgctaaggagatcgcatgaaaaatatcgttcctgattaccgccttgatatggtgggtgaaccctgcccttatccggcagtcgcaacccttgaggcgatgccgcagttaaaaaaaggggaaatcctggaagtggtgagcgactgtccgcagtcgatcaataatattccactggatgcgcgtaatcacggctatacggtgctggatattcagcaagacgggccgaccattcgttatttaattcagaagtaatccctcattcccgctgtgacccacagcgggaacatcgttacctttgtatcacatagattttacccgcccccactcctattcttttcagtatgatctcaggaggtttctatgtgtggacgctttgcccaatcccaaacgcgtgaagattaccttgcgcttctcgcggaagatattgaacgcgatattccctatgatcccgaacccattggcagatacaacgtcgcgccgggaaccaaagtcctactgctcagtgaacgtgatgaacaccttcatctggatccggttttctggggatatgctcccggatggtgggataaaccgccgctgattaacgcccgcgtagaaactgcggcaaccagtcgtatgtttaaaccgctctggcaacatggtcgggcaatctgttttgccgatggctggtttgagtggaaaaaagaaggcgacaaaaaacagcctttttttatctatcgtgctgatggacaacctatttttatggccgcgataggtagcacaccatttgagcgtggtgacgaagccgaaggatttttgatcgtcactgctgcggcagatcaaggtctggtagatattcatgaccgccgcccactggtactgtcgccagaagctgcgcgggaatggatgcggcaagagattagcggtaaagaagcctcagaaatcgcggccagtggctgtgttccagcaaaccagttctcctggcacccggtatcgcgcgcggtgggtaatgttaaaaaccagggcgcggagttaattcaacctgtttgataagcctggagattattgatcaacaatactgcgtcataagaaatctctattagacaaagatttcattacctgttggcatattgcaaaaataacaccaatacggaatcgtcatgttcacgattaaaacagatgatctcacccatccagcagtgcaagcattagtggcttaccatatttccggcatgctgcagcagtctccccccgaaagcagtcatgctttagatgtgcaaaaattacgtaacccgacagtgacattctggtcagtatgggaaggcgaacaactcgcaggaattggtgcgctgaagttgctggatgataaacacggcgagctgaaatcaatgcgtaccgcgccaaattatttacgtcgtggtgtcgccagtctgattttacgccacattttgcaggtcgcccaggacagatgccttcatcgcctgagcttagaaacgggtacacaggctggatttacggcctgccatcaactttatttgaagcatggtttcgctgattgcgaaccgtttgctgattatcgacttgatccacacagtcgatttttatcattgacgctatgcgaaaataatgaattgccatgagccagacgcagcacattcttgcattcgacgtgctgcgcctttatttatcaccagcaggaaacgccttgtccatagacgccccttccacatgcgccacaagaaacctctattccagtgacacaattgcgcctaattaattacatttaatatttaattatgagttcctcaccatctattacatactttttaaccatatcggaatatttatcataatcagcgggattcgtaacaatatattttcgctgcgatctttcatagcaaatccctgtcaaagtccatgatataaaaatgtctcttcaaaagaattacattctttaaaaagtaattctttattgctatatatcgcagagacaacctcaatatcacactccatacgtgctttctccagatgatttgggaagtattgaatttcttttatcttattatcgccacaattaaacagcttagtagtctcaggcattgctggtatttaccatattttattgcgataaatagaaattgtcatagcctttgacggagatgagtcaacacgcgatatcagattattatctacggagacctgggtaattccatcggatacttttggaaataccatataattattgaaatcgagctctaattctttgcagaatttgggaatttgtattgtggcaaggccattatgacgaagataaagcacctcaatccaggatggaagaggtggcaaagaccccaagtgaagatctgttaagtcaagtttactattgtggagttcaacacatttaaacaatctcaccaatgctatatccacattttttttgaagtcattcgatgcgccttcttttactgaattagcccagtcgctgaaacctttgcaaagtctggaatctgtaattttcgtaaagttgtctagaaactctgcaatattagtcgatataaactctaatttatgccgaatgggtgggttaccagttccctgattttttctatcatgataaaacctatcttattataaatcgagaaatcttgaaaccagagactataatcaccccattcgaaatattctgagtgcaataacttaaattctgacagcatattaaataatttgctgtcttcactaattggtgtaaacttaccatttccaagacaactgactaactcacttgataattcatttatgattgcatcatcagatactaactcatgttgttttatcgtagattcagtattagatgtgactttatttaattgaaccggctgagtttttaacgaaagatcatttaatggaaacatttacactcctgtttaataaattatattgcccagggcgcattctaaaacacaataaaattaccactatcaaaaatcgctcatatccatcgcccggaatatgaataaaaacatcaacaaagattaaattatccagaggttactgttgcgtctgtggtcgtaacaacatccgacgtggtgatgtgtcaaatgagacgctctgatgttcaggggggttatcgcgtatacggatcgtggatggcagaaaacgttcaggatcaggtatccattttaaaccagaaattgagtgagtttgccccatccatgccccacgcggtgagatcggatgtaattaacaacaggttacaaaacctacacctgcatgctcatcacttcctgatacgccgccaccagcttattacgcacctgaatccccatttgcatagaaactgaggctttttgcatatcggtcatcacatcgtttaacgccacgccgggttcaccgagagtgaatttttctgcctgcgtgcgggcagctgtttgtgtatcactaatgcgatcgagcgcggcgtgcagctgcccggcaaaactaatggtcggttgcggcagtgattcctgcgcacgcgcactcatcgccgtagcctgtaactggctgataaccccttcaatcccctgtatcgctgacattctcgtctcccggataatttctggtagcaaagcctaccagtaagtcaataagacaaaggcgctaaatagcaacaaaaaaacgggtttattggcggatagaaaaaaacgaaagcacaaataatgggagcgtcaatttttcgagtttgctgacccgggagtgagtcttgttccactttgccaataacgccgtccataatcagccacgaggtgcgcgatgaatgcgactgcagcccagacaaaatctcttgagtggcttaatcgcctgcgtgcgaatccgaaaattccattgattgttgccggttccgcggcagtggcggtcatggtcgcactgatcctgtgggcgaaagcccccgactaccgcacattattcagcaatctttccgatcaggatggtggcgcaattgtcagccaactgacgcaaatgaatattccttaccgcttcagcgaagccagcggcgctattgaagttccggcagataaagttcacgaactgcgtctgcgcctggcacaacaaggtttgccaaaaggcggcgcggtcggtttcgaactgcttgatcaggaaaagtttggtatcagccagttcagcgaacaggtgaattatcagcgggcgctggaaggcgagctttctcgtaccatcgaaactatcggcccggtaaaaggggcgcgcgtacatctggcaatgccgaaaccgtctttattcgtccgtgaacaaaaatccccttctgcatcggtgacggtaaatctgttacccggccgcgcactcgatgaagggcaaattagcgccattgtgcatctggtttccagcgccgttgctggtctgccgccgggaaacgtcacgctggtggatcagggcggacatctgttaacccagtccaataccagcgggcgcgatcttaatgacgctcagttgaaatatgccagcgatgtcgaaggccgtattcagcggcgtattgaagcgatcctgtcgcctattgttggtaacggtaatattcacgcccaggttacggcgcagctggacttcgccagtaaagaacaaacggaagaacagtatcgccctaacggtgatgaatctcatgcggcgcttcgttcacgccagcttaatgagagcgagcaaagcggttccggttatccgggcggcgtaccgggggcgttgtcgaatcaaccggcacctgcgaataacgcgccaatcagcacgcctccggcaaatcaaaataaccgccagcagcaggcgagcaccaccagcaatagtgggccgcgtagcacacagcggaatgaaaccagtaactacgaagtcgatcgcaccattcgtcataccaaaatgaacgtgggcgatgtgcaacgtctgtcagtcgcggtcgtggtgaattacaaaaccttgccagatggcaaaccgttgcctctcagcaacgaacagatgaagcaaattgaagatctgacccgcgaggcgatgggcttttctgaaaaacgcggtgactcgctcaatgtcgttaactcgccgttcaatagcagtgacgaaagcggcggagaactgccattctggcaacagcaagcgtttatcgatcagttacttgctgccggtcgctggttgctggtactgctggtggcgtggctgctgtggcggaaagcggtacgtccgcagctaacacgtcgcgctgaggcgatgaaagctgtacagcaacaggcgcaggcccgcgaggaagtggaagatgcggtggaagtccgcctgagcaaagacgaacaactacaacaacggcgcgctaaccaacgtctgggggcagaagtcatgagccagcgtatccgtgaaatgtctgataacgatccgcgcgtggtggcgctggtcattcgccagtggataaataacgatcatgagtaacctgacaggcaccgataaaagcgtcatcctgctgatgaccattggcgaagaccgggcggcagaggtgttcaagcacctctcccagcgtgaagtacaaaccctgagcgctgcaatggcgaacgtcacgcagatctccaacaagcagctaaccgatgtgctggcggagtttgagcaagaagctgaacagtttgccgcactgaatatcaacgccaacgattatctgcgctcggtattggtcaaagctctgggtgaagaacgtgccgccagcctgctggaagatattctcgaaactcgcgataccgccagcggtattgaaacgctcaactttatggagccacagagcgccgccgatctgattcgcgatgagcatccgcaaattatcgccaccattctggtgcatctgaagcgcgcccaagccgccgatattctggcgttgttcgatgaacgtctgcgccacgacgtgatgttgcgtatcgccacctttggcggcgtgcagccagccgcgctggcggagctgaccgaagtactgaatggcttgctcgacggtcagaatctcaagcgcagcaaaatgggcggcgtgagaacggcagccgaaattatcaacctgatgaaaactcagcaggaagaagccgttattaccgccgtgcgtgaattcgacggcgagctggcgcagaaaatcatcgacgagatgttcctgttcgagaatctggtggatgtcgacgatcgcagcattcagcgtctgttgcaggaagtggattccgaatcgctgttgatcgcgctgaaaggagccgagcagccactgcgcgagaaattcttgcgcaatatgtcgcagcgtgccgccgatattctgcgcgacgatctcgccaaccgtggtccggtgcgtctgtcgcaggtggaaaacgaacagaaagcgattctgctgattgtgcgccgccttgccgaaactggcgagatggtaattggcagcggcgaggatacctatgtctgataatctgccgtggaaaacctggacgccggacgatctcgcgccaccacaggcagagtttgtgcccatagtcgagccggaagaaaccatcattgaagaggctgaacccagccttgagcagcaactggcgcaactgcaaatgcaggcccatgagcaaggttatcaggcgggtattgccgaaggtcgccagcaaggtcataagcagggctatcaggaaggactggcccaggggctggagcaaggtctggcagaggcgaagtctcaacaagcgccaattcatgcccggatgcagcaactggtcagcgaatttcaaactacccttgatgcacttgatagtgtgatagcgtcgcgcctgatgcagatggcgctggaggcggcacgtcaggtcatcggtcagacgccaacggtggataactcggcactgatcaaacagatccaacagttgttgcagcaagaaccgttattcagcggtaaaccacagctgcgcgtgcacccggatgatctgcaacgtgtggatgatatgctcggcgctaccttaagtttgcatggctggcgcttgcggggcgatcccaccctccatcctggcggctgtaaagtctccgccgatgaaggcgatctcgacgccagtgtcgccactcgctggcaagaactctgccgtctggcagcaccaggagtggtgtaatgaccacgcgcctgactcgctggctaaccacgctggataactttgaagccaaaatggcgcagttgcctgcggtacgtcgctacgggcgattaacccgcgctaccgggctggtgctggaagccaccggattacaattgccgctcggcgcaacctgtgtcattgagcgccagaacggcagcgaaacgcacgaagtagaaagcgaagtcgttggctttaacggtcaacggctgtttttaatgccgctggaggaagtcgaaggtgtcctgcccggcgcgcgtgtttatgccaaaaacatttcggcagaagggctgcaaagcggcaagcagttgccgctcggtccggcgttattaggtcgcgttctggacggcagcggtaaaccgctcgatggcctgccctcccccgatacgacggaaaccggtgcgctgattaccccgccatttaacccgttgcaacgtacaccgattgaacatgtgctggacaccggcgtgcgcccaatcaatgccctgcttaccgttgggcgtgggcagcgtatggggctgtttgccgggtccggcgttggtaaaagtgtgctgctggggatgatggcacgttacacccgcgccgatgtcattgtcgtgggtttgattggtgaacgtgggcgcgaagtaaaagattttattgagaacatcctcggtgccgaagggcgtgcacgctcagtggtgattgccgctccggcggatgtttctccgctcctgcgaatgcagggtgccgcctatgccacgcgcattgccgaagattttcgcgatcgtggtcagcatgtgttgctgattatggactccctcacccgctacgcgatggcccagcgtgaaattgcgctggcgattggcgaaccccccgccaccaaaggttatccaccgtcggtgtttgccaaattaccggcactggtcgagcgtgccggaaatggcattagcggcggcggctcgattaccgcgttttataccgtgctcactgaaggcgatgaccagcaggatccgattgccgactccgcgcgggcgatcctcgacggtcacattgtgctgtctcgccgactggcggaagccgggcactatccggctatcgatattgaagcgtcgatcagccgcgcaatgacggcgttgatcagtgagcaacattacgcgcgagtgcgcaccttcaaacagctgttgtcgagttttcagcgtaaccgcgatctggttagcgtcggcgcgtatgccaaaggcagcgatccgatgctcgataaagccatcgccctgtggccgcagctggagggctatttgcaacaaggcatttttgaacgcgcggactgggaagcgtctctccaggggctggagcgtattttcccgacagtgtcataacccaggagataacggcagatggcagaacatggtgcgctggcgaccctgaaagatctggcagaaaaagaggtagaggatgccgcgcgcctgctgggtgaaatgcgtcgcggatgtcagcaggcggaagaacagctcaaaatgctgattgattatcagaatgaatatcgcaataacctcaacagcgatatgagtgccgggataaccagcaaccgctggatcaactatcagcagtttatccagacgctggaaaaagccattactcagcatcgccagcaacttaatcagtggacgcagaaagttgacattgccctgaacagttggcgagaaaaaaaacaacgtttgcaggcctggcagacactgcaggaacggcaatccacggcggcactgcttgcagaaaaccgcctcgatcagaaaaagatggatgagttcgcccagcgcgccgccatgaggaaacctgaatgattcgcttagcgcccttgattaccgccgacgttgacaccaccacattgcctggcggcaaagccagcgatgctgcacaagattttctcgcgttgttgagcgaagcattagcaggcgagacaactaccgacaaagcggccccccagttgctggtggcaacagataagcccacgacaaaaggcgagccgctgatcagcgatattgtttccgacgcgcaacaagctaatttactgatccctgtggatgaaacaccgcctgtcatcaacgacgaacaatccacatcaacaccgttaaccaccgctcagacgatggcgttggctgcggtggctgacaaaaatacgacaaaagacgaaaaagcggatgatctgaatgaagacgtcaccgcaagcctgagcgccctttttgcgatgttgccgggttttgacaatacgcccaaagtgactgatgcgccgtcaaccgtgttaccgacagagaaaccaacgctcttcacaaaactgacttctgagcaactcacaacagcacagcctgatgacgcccccggcacaccagctcagccattaacaccgctggtagcagaagcccagagtaaagcggaagtcatcagcacaccttcaccggtgaccgctgccgccagcccgctaatcactccacaccagacacagccactgcccaccgtcgccgcacctgttttgagtgcaccgctgggttctcacgaatggcaacaatcattaagccagcatatttcgctgttcacccgccaggggcaacaaagtgcagagttgcgtctgcacccgcaggatttaggtgaagtgcaaatctccctcaaagtggatgataaccaggcgcaaatccagatggtttcaccgcatcagcatgtacgcgccgccctggaagcagcgctgccggtactgcgcacgcagctggccgaaagtggcattcagttagggcaaagcaacatcagtggcgaaagctttagtggtcagcagcaggccgcttcccagcaacagcaaagccaacgcacagcaaaccatgaacctctggcgggggaagacgacgatacgcttccggttcccgtctctttacaagggcgtgtaacaggcaacagcggcgttgatattttcgcctaacgtcagaggtagcaccgtaatccgcgtcttttccccgctttgttgcgctcaagacgcaggataattagccgataagcagtagcgacacaggaagaccgcaacacatgactgattacgcgataagcaagaaaagcaagcgatcgctttggatcccgattctggtattcattaccctcgcggcctgtgccagcgcaggttacagctactggcattcgcatcaggttgccgctgacgacaaagcgcagcaacgcgtcgtgccctcaccggtcttctacgcgctggataccttcacggtcaatttgggcgatgcggatcgcgtactttatatcggcataaccctgcgcctgaaagatgaagctacccgctcgcggctgagtgagtatttgccggaagtccgtagtcgcttgctgttactgttttcgcgtcaggatgctgccgtactggcgacagaagaaggcaagaaaaacctgattgccgagattaaaaccacactttccaccccgcttgttgccgggcaaccgaaacaggatgtcaccgacgtgctgtataccgcttttattctgcgataacgacatgggcgatagtattctttctcaagctgaaattgatgcgctgttgaatggtgacagcgaagtcaaagacgaaccgacagccagtgttagcggcgaaagtgacattcgtccgtacgatccgaatacccaacgacgggttgtgcgcgaacgtttgcaggcgctggaaatcattaatgagcgctttgcccgccattttcgtatggggctgttcaacctgctgcgtcgtagcccggatataaccgtcggggccatccgcattcagccgtaccatgaatttgcccgcaacctgccggtgccgaccaacctgaaccttatccatctgaaaccgctgcgcggcactgggctggtggtgttctcaccgagtctggtgtttatcgccgtggataacctgtttggcggcgatggacgcttcccgaccaaagtggaaggtcgcgagtttacccataccgaacagcgcgtcatcaaccgcatgttgaaactggcgcttgaaggctatagcgacgcctggaaggcgattaatccgctggaagttgagtacgtgcgttcggaaatgcaggtgaaatttaccaatatcaccacctcgccgaacgacattgtggttaacacgccgttccatgtggagattggcaacctgaccggcgaatttaatatctgcctgccattcagcatgatcgagccgctacgggaattgttggttaacccgccgctggaaaactcgcgtaatgaagatcagaactggcgcgataacctggtgcgccaggtgcagcattcacagctggagctggtcgccaactttgccgatatctcgctacgcctgtcgcagattttaaaactgaaccccggcgacgtcctgccgatagaaaaacccgatcgcatcatcgcccatgttgacggcgtcccggtgctgaccagtcagtatggcaccctcaacggtcagtatgcgttacggatagaacatttgattaacccgattttaaattctctgaacgaggaacagcccaaatgagtgacatgaataatccggccgatgacaacaacggcgcaatggacgatctgtgggctgaagcgttgagcgaacaaaaatcaaccagcagcaaaagcgctgccgagacggtgttccagcaatttggcggtggtgatgtcagcggaacgttgcaggatatcgacctgattatggatattccggtcaagctgaccgtcgagctgggccgtacgcggatgaccatcaaagagctgttgcgtctgacgcaagggtccgtcgtggcgctggacggtctggcgggcgaaccactggatattctgatcaacggttatttaatcgcccagggcgaagtggtggtcgttgccgataaatatggcgtgcggatcaccgatatcattactccgtctgagcgaatgcgccgcctgagccgttagtgatgaataaccacgctactgtgcaatcttccgcgccggtttctgctgcgccactgctgcaggtgagcggcgcactcatcgccattattgccctgatcctcgctgctgcctggctggtaaaacggttgggatttgcccctaaacgcactggcgttaacggtctgaaaattagcgccagtgcttcactgggcgcgcgtgaaagggttgtggtggtcgatgtggaagatgcacggctggtgctcggcgttaccgcaggtcaaatcaatctgctgcataaacttcccccttctgcaccaacggaagagataccgcagaccgattttcagtcggtcatgaaaaatttgcttaagcgtagcgggagatcctgatgcgtcgtttattgtctgtcgcacctgtccttctctggctgattacgcccctcgccttcgcgcaactgccgggtatcaccagccagccgctgcctggcggtggacaaagctggtcgctcccggtgcagacgctggtgttcatcacctcgttgacgtttattccggcaattttactgatgatgaccagtttcacccgcatcatcattgtttttggtttattgcgtaacgcgctgggaacaccctccgcgccacctaaccaggtattgctggggctggcactgtttttgaccttttttattatgtcaccggtgatcgacaaaatttatgtagatgcgtaccagccattcagcgaagagaaaatatcaatgcaggaggcgctggaaaaaggggcgcagccgctgcgtgagtttatgctgcgtcagacccgtgaggcagatttagggttgtttgccagactggcgaataccggcccgttgcagggacctgaagccgtgccgatgcgcattttgctcccggcctacgtgaccagcgagttgaaaaccgcatttcagataggcttcacgattttcatcccttttttgattatcgacctggtgatagccagcgtgttgatggcattggggatgatgatggttcccccagccaccattgctctgccctttaaactgatgctgtttgtactggtggatggctggcaattgctggtcggttcgctggcgcagagcttttacagctagagaggcaaaatgacacctgaatcggtcatgatgatggggactgaagcgatgaaagtcgcgctggcactggctgccccgctattgttggtagcgttggtcacgggccttatcatcagtattttgcaggccgccacgcagattaacgaaatgacgctgtcgtttattccgaaaatcatcgccgtatttatcgccattattattgccggaccgtggatgctcaatctgttgctggattacgtccgcaccttgttcactaacctgccgtatatcatcgggtagccgtactatgttgcaggtgacaagcgaacaatggctatcctggttaaacctgtacttctggccgttactgcgcgtgctggcgctgatctccaccgcgccgattctgagcgaacgcagcgtaccgaaacgggtaaaactgggtctggcaatgatgatcacgttcgccattgccccatcattacctgccaacgatgttcctgttttttcgttctttgctctgtggctggccgtgcagcagatcctgatcggcattgcgcttggttttaccatgcaatttgcctttgccgctgtgcgaaccgctggcgaaattatcggtctgcaaatggggctgtcatttgcgacgtttgtcgatccggccagccatcttaatatgcccgttttagcgcgtatcatggatatgctggcgttactgctgttcctgacatttaacggtcatttatggttgatttcactgctggtcgatacctttcacaccctgccgattggtggcgaaccgttgaacagcaatgcgtttctggcactcaccaaagcagggagtttgattttccttaacgggctgatgctggcgttaccgctcattactctgctgctgacactgaatctggcattaggtttacttaatcgtatggccccgcaattatccatttttgttattggatttccattaactctgactgtcggcatctctttaatggcggcattaatgccgttaattgcacctttttgcgaacatttattcagtgaaatttttaatttgctggctgatattattagtgaattgccattaatataattccgtaacgtttatcatgttatcctaaggattatccgaaaaataatacctacgaacatcttccaggatactcctgcagcgaaatatttgttttaagctcactcacatatcgcaacatttactttactttaagacaattccaggcaaattatacaacactttacgggatagtaagtccgcctgaaaaatcgcgagagtggcgcattaggtgacccatgttgttccgtttagtcatgatgaaatattcaggtaaggggaattatcgttacgcattgagtgagggtatgccatgtcaacgattattatggatttatgtagttacacccgactaggtttaaccgggtatctgttgagtagaggggttaaaaaaagagaaatcaacgacattgaaaccgttgatgaccttgccatagcttgtgattcacagcgcccttcagtggtgtttattaatgaggactgtttcatccacgatgcttctaacagtcagcgtatcaagctcatcattaatcaacatcccaatacgttatttatcgtttttatggcaattgccaatgttcattttgatgaatatctattggtcagaaaaaatttattgatcagttctaaatcgattaaaccggaatctctcgacgatatccttggcgatattctgaaaaaagagacaacgataacctcgtttttaaatatgccgacgttatcattgagccgaaccgaatcgagtatgttgcgaatgtggatggcaggtcagggaaccattcaaatctctgaccaaatgaatatcaaagccaagaccgtttcatcgcataaaggtaatattaaacgtaagatcaaaacgcataataaacaggttatctaccatgtcgtccgactgacggataatgtgactaatggtatttttgtcaacatgcgctaacacattctgactggtggtttcccaccagtcaggctgaataagattactctgctttctccacaaagataccgtcctgatgccctgcttcattaaagaaccagatgccgagcgggtagtcttccagcgaaaccaggtacattgtgccttcactaaactcctcaactgccagtaccacgccaggacgacgcggaccgccatccgttttgactgttacccgatcattcaccttcatcgttttcctcctgtggctttgtgccagtgtagaacaatttcgtttttctggcagcgccaggcgcgcgcgagtgctgattttctcgacggtctatacttaagagatgccaggcggacttaacgactggcggcaacaacagagtaacggttgcgaggaaagatgatgaaaaccgcaaaagagtacagcgataccgcaaaacgtgaggtcagcgtcgatgtcgatgccctgctggcggcgatcaatgaaattagcgaaagcgaagttcatcgcagccagaacgattctgaacacgttagcgtcgatggacgtgaatatcatacatggcgtgaattggcggatgccttcgaactggatattcatgacttcagcgtctctgaagtgaatcgttgaatgcacaataaaaaaatcccgaccctgagggggtcgggatgaaacttgcttaagcaagaagcacttaaaaaattcgttacaccaggaaatctgatgtgttcatcaccttatccgcaatttttttcgctgacaagaaaatattcgccatatgaatgattaacgctacttatgaatagaaatgtgacgcacgtcaccccttggtggctctggcgtcagcgggatcgctcccgaaaaaatcatctttgataatttgtgcggttttgagaatcatcctggtaagaggagtactgcgcgactatgttttcaattcaacaaccactactggtttttagcgatcttgatggcaccctgctggacagtcatagttatgactggcaaccggcagccccctggctcacccgtttacgcgaagcaaatgttcccgtcattctctgtagcagtaaaacatcagcggaaatgctgtacttgcaaaaaacgttggggctacaaggtttaccgctgattgccgaaaatggcgcagtgatccagcttgctgagcaatggcaggagatagacggttttccacgcatcatctcaggtattagccatggcgaaatcagcctggttttaaatacgctacgcgagaaagaacattttaaattcacgacttttgatgatgtcgacgatgcaaccatcgccgaatggacgggattaagccgtagccaggcggcgctgacgcagcttcatgaggcgtcggtaacgctaatctggcgcgacagtgacgagcgtatggcacaatttaccgctcgtctgaacgaactgggcttacagtttatgcagggtgcgcgcttctggcacgtactggatgcttctgccggaaaagatcaggctgccaactggattatcgcgacctatcaacaattgtcaggcaaacgcccaaccacacttggcctgggcgatgggccaaacgatgcgcccttactggaggtaatggattacgcggtgattgtgaaagggctaaatcgtgaaggggtgcatctgcatgatgaggatccggcccgcgtctggcgaacgcagcgtgaaggaccggaaggatggcgtgaagggctggaccattttttctccgcccgttaagcgttatcgctcgcgaatacccgattacgcccagcctgtttagcgagataaagccgacggtcggccagtgactggagttgttcaaaatcataatcaccggtttcctcgctgctgcttacccccagcgaggcactgatgcgtatcgtcgtactcttggcgatcaacatctctttttcatttaatttcagtcgaatacgttctgcgacctccgcagcctccgtcagactcgcgcctggcagaatcacacaaaactcctcaccaccgacccgcccggcaacgtcctgcgcacgcaaggaactgctaattaatccggcagcatgagaaagaacacggtcgcccgcctgatgaccaaagcggtcattaatcgctttaaaatggtcaagatcgacctgaatgacagaaaaaggatgttggtgcgtctgacacaatttagcgagcggacgggctttttcgaacagtgcgccacggttatataaacgcgttaaggtgtcgtgccacgcctgccactgcaacgagctttgcagaacatacatgttgctaaccatccggcgaatcacataccaggagatgagtaacatggtggtaaagagcgcccacagcagggttaatgcaatgctgatactgccgaaatcgccgcgcacgccttcgcttaacgtatggacacgcaccagcacaccgtcgaaatggtccagacgttcccagctaacatagcgactgtccatacgaatgccgccccgcgtgtcatgttccattgcctgcgccagcaaggccagttcacgaggatcaaaaatattccctgttggatggtcaggattggaagaggtcaaaaatctcagcttactgtcatagagctgatactcaccatcgaggtttttatcgatggcgtttcttaaaaattgctgcatagtacgcacgggaatactcatccccagcacgccataccagtagttattactgtctaccggaacactgacggtaacctgcggttcagtattgctggcgtgttccggttgcgaagtgaaccagcgtaccgcgcggtgacgattttctcgttgtgaatggccaataaaccagggttgggtgacatagccgtaataacgcgttggaacattgcgcgtaaacaaggtcggctgcgtcgaaacgtaaaatccggcacgcgagacatacatcgcctgttcaaccatcgacgaggagttgtgcgctagtcgcagcaagtaaccaacttccagtgcagcggtaatttcattgtcgaggctttcattttcgcgagacaggagattcccctcgctgactaatgcatccgacacaccattaactggcagagtgcgtcgtcggttgagttcgattttccaggcgtgctcgtcgcgatgctgttcgaactcggttacagcatcacgcagagaggtgaaatccagtggcgctacgagagcttcgcgcatgccattacgtaaaaagatcagtttgtcgacgttatactgcaaatgcttatcgagcgcgttggcaacgttttccagatgattacgctggctggagatataggcatcttccagcaccaccacttcacgccaggtgagcaaggtggaaaaaagcaataccacgataaagcagagattaacgacatgaccaggccccaggcggcgtgcgagttttttcaaccagctctggttttccatttttgtctcgtgctgcaccctgacgactcccaacctgcttttttatgattctggcataacctggcgatagcgtaccgcaaaacagcgataattttataatggtggcatgataagacgcgactatcattcattgcaggcattagcacaccaggccggatgtgatccggcctgatgttaatgataccctttcacacttcttccgcagaacgactcccctcccccggaacaagctcggtttcatgaaaagcttcccgcttgaccccgtaaccgtcataccaacgacactcaaccataccgctggagtatccagtgacaatcatccgcgggccgccctctttaaccgtaacttcctcactaaccataaagctcatactcgcctccttttttcgagtgaaacttgttcaccttagttgaagatggcgaattttgcataatagccagtgcgagtattaatgtgcctgaccgcgcattttctctacggctttcactcccagcaccacgatgccgccgatgataaatccaagaatcagatttaaaacagtcggtaatatcatcgccactactgcactttgctgcccggcgaaatgttcaatggcgtgatgcagcggcgcaattccatgtaccacaatcccaccgccgacgaggaacatcgccagcgtgccgacaatcgataacgctttcatcagccagggcgcgataatcaataaccctttacctaatgcctgcatcagcgcgctggatttttccgccagccaataccccaggtcatcaatcttaacgataacccctaccagaccgtagacgcccacggtcactaccagcgcgatgcctgaaagcaccagcacctgattaagcaacggcgcttcggccacaatccccagcgtgatggcgacgatttccgcagacaatataaaatcggtacgaatcgccccttttattttgtccttttcaaacttcagcggatcctgcgccgccagcttctccagacgctgctggctctgcgccggatcttctttatgtttacgcgcctccagcatatgcagcactttctctactccttcaaagcagagaaacgcgccaccaatcatcaacagaggcgtaatcgcccacgggataaacgcactgatgatcagcgccagcggcaccagaatcactttattaatcagcgatcctttcgccacgccccagaccacgggaagttcccggttggcccgcacgcctgaaacttgttgcgcattgagcgataagtcatcccctaatacaccggcggttttcttcgccgccagtttgcccatcacggagatatcgtccagtagtgtggcgatatcatcgagcaacgtcagtaaactactcccggccaaaagcattccctctcatttttattgttgaagggtgtaagtatgaagcaaaaacggcagctctgatacttgcttcacaggtcaacatttttttaacaatcaagtgcaattatatctctcgccagcagaatgattttcacgtttactatgaaccacctttttatttccaccgtgagggattatgcgtttccgccagttgttaccgctttttggcgcgctgtttgcgttgtatatcatttggggctcaacctattttgtcattcggattggcgtggaaagctggcctccgttaatgatggcgggcgttcgattcctggcagccggtattttattgctggcatttttgctactgcgcggacacaaactccccccgctacgtccgctgctcaatgccgcgctgattggcctgttattgctggctgtcggtaatggcatggtgacggttgccgaacatcaaaatgttccttccggcatcgccgccgtagtggttgcaaccgtgcccctctttaccctgtgcttcagccgcctgtttggcattaaaacgcgcaaactggaatgggtgggtattgccattgggcttgccggaatcatcatgctcaatagcggtggaaatttaagcggcaatccgtggggcgcgattctgattttaatcggctcgattagctgggcgtttggctcagtttatggctcgcgcattaccttacctgtagggatgatggcgggtgcgattgagatgctggcggcaggcgtggtgttaatgatcgcgtcgatgattgcgggtgaaaaactgacggcgctcccttccctttcaggcttccttgcggtcggctatctggcgctgtttggttcgattatcgccatcaacgcttatatgtatttaatccgtaatgtcagtccggctctcgccaccagctacgcttacgttaacccggtggtcgcggtcttgctgggtacgggactgggtggagaaacactgtcgaagattgaatggctggcgctcggcgtaattgtcttcgcggtggtactggtcacgttgggaaaatatctcttcccggcaaaacccgtagttgcgccagttattcaggacgcatcaagcgagtaaatgaatcccctgcgtgtcgatctgcgcgctggcaccttcgccgcagatccactcttccagacgctcggtaagcgcttcatccgtcagcttctcgcgcccacgtaacgcgcactcccagacaatcaatacgcgccagccgagttcctgcaagcgactgatatcgcggcgatcgcgctcaacatttttacctatcttctccagccagaactcggttcgagtcgcaggcactttaaacagatagcagtgatgatgatgccagaagcagccatgggtaaatatcacgcagcgatattcatcaacgacaaaatccggacgtccgggcagactggcgtcctgaacgcgaaatgccaggccctgcccggttaacagactggcgaggcgcttctctatcgccgtatcacgcgtggcaatcgcgcgcatatttttgctgcgagtggccttatcgtgaacgtcggccatgttgtgcctcttgctgacgcaacgccaccgcctgtttgatttttggctcaagcagttttgccaccgcggcaaagaccggcacgaccaccgagttaccgaactggcgataggcctgagtgtccgaaaccggaatacggaatttcgcttctcccggcgcttcaaaacccattaagcgcgcgcattcccgaggcgttaaccgacgtggacgatgttgctgattcagcggatcgtcaaagtctttctcacccgtggccatatcccagccgcgatcgattaaaatttccgcgccatctttgtaataacgcgcagacagcgtacgcgtgacgctttgcggattgttcggataaaccattccataaccgaagccgttaccgcgcgcctgatgttttttcgcatatcgatagaggtacttccacagcaccggcgtcaggatatatttcgcctcgaccatcgggtccaacagctgcgccagcgtcactcgctgcgcagggaaacattcgctgatatcacgcagggtaaaatcggctttcagattcagatcgcgacgaaaacccaccagcacgatgcgttcacggtgctgcggcagaaaatgtttgccgtcgatgattttcggatcgtctggcccattatcttctgcatcagccacgtcatagcccagttcgtccagcgtctgcatgatgatgcggaacgttttaccctggtcgtgacttttcaggtttttgacgttttcgagcacaaacatcgccggacgacgcgcgtcgataatgcgtaccacatcaaaaaacagcgtgccctgggtatcgcaggcaaaaccgtgcgcccgcccgagcgagttctttttcgatacgccagccagcgaaaatggctgacaagggaaaccggccagtaaaacatcgtgttcaggaatgtgttgacgaatatgttccgccgccgcctcatcactcacgccttctttatggctgagggtgatgtcgcggatatcttcattaaaatgatgcgtcgccggatcgcaataatggttggctttataagtgcgtaccgcatgtttgttccattcgctggtaaacacgcactgtccgccaatcgattcaaaaccgcgacggatgccgccaattccggcgaatagatcgataaagcgaaacgcataatgcggatgatgtgccggtggtttgggtaataacgtttgcagatgggcgaactctttctcacttaaacggtgccatgccgagtcattcgccagcgcacgttttaaaattgccgcgctccagtgattctcacctacaccattaagctgcgccaccaacgttttaacatcataaatttgcagcagtttctccagcattgcctgtgcggcattcccggtgctgtatgaatcggttactgatatattttcctgcatagatttcaccggccatctgagatggccgacaggttaacataattacagccatttagggccacgcgctcagccagcggatgaaaacgcatctatcaccttgtgatcgacaccttcattctcccccgccagttcggcactgagcttcgccataaactcgactaaaaaatgcgcgttgtgctgcgccagctgcttgcctcttgcggtttgcatggtttgcggtagcttcagcaacttagtctggaaatgatccagcgcgtagcgtttatcatcaagcgggcgatgctgtgcgaacggatcttcaccatcaaacagcgccacgcccaatgcccctgaaacggcaaacacgcgcgccaggccaatcgcccccagggcttccagccgatccgcatcctggacaattttagcttccgttgttaagggggcgatttgcgcgctgaaactgtgagcggcaatggcatgacaaacggcctcgattttctccgccggaaattgctcgaactcttcacggagcaggcgacgcgtctcttctgccgccaggattgaagaacgctgcctttgcggatgatttttcgccaggctcacaatatcgtgaaaataacaggcggttaaaatcaccagcatatcgacatcgtcatctgccgccagcttctgtgccgtagcccagacgcggcgaaaatgacacacgtcatgggccgcgtcctggtgctgatgatggtttttcaaccagttttcgaactgtgcctgccagtgttgtaagtccatacgcgctccgttgccaaagagtcgccaccttagcagtttttattcatagcgtctgctacgtgcgggacgaggtcgggtgtaccaggcaatgctgcctaacaatgccccgaccagagccataaataaaaatccgaccagtgcccctaaccactttcccgcggtagagcctaaatcgctttcaaatcccgacacgggggcatcgggaatccggctcatcacccagatgtaacgcgccattgcccagacgaaatagccacaccatgtatagaaagcccacaaagccagtttgccgccagggctgcgagagagtctctcttccatctttgtcgaaccgtattccattttgagataacccggaaaattcagacttagtactattatgtgataaaagtcacatttttccacattggatgagccagtcaagactcaatcattttttgaacaaatagataaattttgcgcaacggcagtgaatacaggaaaaatcgttttgagcgattttatttatctttgatatcggctttattaattcatttaatcaatatattagcactgattacaattatacctttttattattctgtgtcatgatgcttccgttattagccttttatcgtcttgtttatattttttgggccggcatgatgccggcttttttttatgccttcattaatgtgcgcctgatcacaccagccgtttggcgcaacaatcattgataccccctatgtttccgctcaactcataacatattgatatacatttataattttcatgaatatttatatttagaattcataattatgaattatattaaatagattagaaacattttgatatcttttaaatacatttgttacatgtaatccttaaaataaaatgaacttcatagaatagtatccaaatgtgcttttttttggataacggcacttattgatatattcatgaagattataatcacaagggaatacataatgaaaagaaaagttctggcaatgctggtcccggcgttattagttgctggcgcagcaaatgcggctgaagtctataataaagatggtaataaactggatttgtacggaaaagtagtgggtctgcactacttctctgatgattctggcagcgatggcgacatgtcatatgcccgtatcggtttcaaaggtgaaactcagatcgctgatcaattcactggttatggtcagtgggaatttaacattggcgcaaacggtcctgaaagcgacaagggtaataccgcaacgcgtctggcatttgcaggtttaggctttggtcagaatggtactttcgactatggtcgtaactacggtgtcgtatatgacgtagaagcatggaccgatatgctgccagaatttggtggcgatacctatgctggcgctgacaacttcatgaacggtcgtgctaatggtgttgcaacctaccgtaacaatggcttctttggttaggtcgatggcttgaactttgctttgcaatatcagggtaataatgaaagtggtggaccattcgggcaggaaggttccggtagtggtgatggccgtagcctttccaaagaaaatggtgatggtttcggtatgtcaacatcctacgacttcgacttcggtttaagtctgggtgctgcatatcaaactctgatcgttcagatcgtcaggttggagttggtttaaatgatcgtaaccatagcaacagaaatgctggtggtgaaaccgctgaagcatggactgttggtgcaaaatatgatgctaataatgtgtatttagcagctatgtacgctgaaactcgcaatatgaccccatatggtggtggcgagtttgataatggtgaatcaagatcagccatcgctaacaaaacccaaaactttgaagttgttgctcagtatcagttcgactttggcctgcgcccgtccatcgcttacctgcaatctaaaggtaaggatttaggcggttgggctcatgacggcaacggcgacccacgttacaccaataaagatctggttaaatacgttgatattggtgcgacctactacttcaacaaaaacatgtccacctatgttgattacaaaatcaacctgctggacaacgacgatgacttctacgaagcaaacggcatcgctaccgatgatatcgttgctgtgggcttagtctaccagttctaatcagtcaactcgctgcggcgtgttactgtaaaactgaacactagcctgagttcgtccctcatcgaactcaggcttttttattggcatttcatctccatctgcggcacacgcaattgccgaagcatatcgatacagcaccttaccctgcccctcctggcacaataacatcaaccagctactcttcaagctaacacccaaatgcatttctttatgaattaatccgtaacaaacacgcttcccatatagaaatatttgcaaaaatagtgcatgaaataagctttttctctaccaatccgggatataaatattcatcagcaccacaatattccacagcactaaatctctccccgccaccccgtacctctgataatggtctaaaatcattgaagccacttgcgacgacgttgctcaataaggaaaatttggcgtgaataatattcaacaccagtgcagcatcatcattacatacttacagccgccgactaccgctttcgatatattgactcaattttccagcctggttaaaaatagcgaccagctcagtcgcaaatatagtgactaccctaactaagcaacaataaggaatacactatgactgttcaaacaagtaaaaatccgcaggtcgatattgctgaagataatgcattcttcccttcagaatattcgcttagccaatataccagtcctgtctctgatcttgatggcgtggactatccaaaaccttatcgcggtaaacataaaattctggtgatcgccgcggacgaacgttatttgccgaccgataacggaaaactgttctcgaccggtaaccatccgattgaaacgttgctgccgttgtatcatctccatgctgcaggtttcgaattcgaagtggcgaccatttccggtctgatgaccaagtttgaatactgggctatgccgcacaaagatgaaaaagtaatgccattctttgagcagcataaatcgttgttccgcaatccgaagaaactcgcggatgttgttgccagcctcaacgctgatagcgaatatgcagcaatctttgttcctggtggtcatggcgcacttattggtttacctgaaagccaggacgtggctgccgctttacagtgggcaatcaaaaatgaccgttttgttatctccctttgccacggcccggcggcttttctggcgcttcgccacggcgataacccactgaatggttattccatttgcgcattcccagacgccgcagacaaacaaacgccagagattggctatatgccgggtcatctcacctggtacttcggcgaagaactgaagaaaatgggcatgaatatcattaatgacgacatcaccgggcgagtacataaggaccgtaaacttctcaccggcgacagtccttttgcagcgaatgcgttgggtaaactggcggcgcaggaaatgctggcagcttacgcgggttaatccctgttacgtttgaatgtaagcgcataatcaatcgcggccgcgttagtactcacgacgtggctgcgttttttcacggttaatttatggcgtactgaagccctatgttaatttctttgcggtaacgtaatccggaacacattatgcttattgagatagtgatacgtagcacttcccccatgcaattcggcaatcgctttgactaaagaaaggcctagtccctgacctacggaatgacgcgaattatctccccgccaaaatctacggaagagtttttcaggctcattaattttcgttccagggctggcgatatcaatattaagatagctgttggtatcaagaaaactggttatatgaatacgcgatttttctggcgaatatctaatggcattaacaataagattcgataacattcgttgtagtaaaattttatccgcaaagatttgctgattgcactcgaccttaaagcaaatctctttctcgtctgaaaggtattcaagatagtccaacaaattttcgacttccttattgagagaaagcgagtccagtttcaccaaaacattgtttttatctgccctggcaagaaacagtatgttctctgttaaccgcgaaatattttccagctcttcaatgtttccggcaattgttttttgatattcagcgatacttctggtttgactgagcgtaacctgattctgacccagtaatgcattaattggcgttctaagttcatgagcgagatcgtcagcaaactgacttagacgctcaaaatctttgactaaagcatgatgcattttattcaacgcctgcccaagaggttttagttctctcggtaatgcgctaacctcaacaggctctcggctatcgttataattcagcgcttccgttacaccactcaactttttgatctctcgtaatcccgttctgattaacagcggacttaatactgagcaaagtacaatggcgacaatgcaaattataatgctattaattttatactgttcaagcatgttatgtctggctgaagccaatttagccacagtaaccgttaatgatggcgaaacttcatcaatattaattcgtaaagcatctatctctgtatcattaataatgcttctgtaaatgccagctgcgctgattgtctcactagcaggtatgttatttaacatgccatcactgacatttgtccggttaacaattttattgatgctatcaccatgaataatcaagatatcctgactaacatccatcatccggttaaagtacacaggtaacgtatctggatttaccccatcaattaacaactgcttgatctgcgctgtccggttaatgagtgttgtatcatcgcgccatttcaactcacttgccaggccattatagagagtccagacaattccggcgccagcaacagacagtagcaatataaaaagcaaggttaaacggacggttatagatagtcttttcattatttttttaccgctacgaatgaatagcccatcccccggattgtggcaattagcttttcaggaaaaggatcatcaacttttgcgcggagcctgcgaatggcgacgtccaccgtattggtatcactatcaaagttgattccccaaatttcactcgcaataaccgttctgggtataatttcgccagctctggaggccagtagccaaagtaactgaaactccttgcgcgtcagtgtaatactgatattgtccctgctcacactatgactaacagagtccattcttaagccgctgatttctaatgttgaattcaaagcgtgatgttgccttaattgtgcccgaacccttgccagcaactcagaaaatgaaaaaggttttaccagataatcatttgccccactgtccagccctctgactctgtcatcgacagaatcccttgcagtaaggcaaataacaggggtttgctttgctgttcttaacgtttgtaagatctgccagccatccatacccggaagcataatatccagaatgatcaatgcataatcatccttcagcgcaagataaagcccatctctgccatcagaaacggcatcgatgacataacccgcttcggaaagcccctgcgttacccattcctgggtcctttgattatcttcaataagtagaatcttcatgaaaataatatgccataaatcatatgttatagaaacagcctggttcattacaaaattgtaatgctgctgtaaggttaccctggacgctttttcgctatcctcaaaactcattcacatgacaaggatataaacatgttaaagcgttatttagtactctcggtagcaacggcagcattttcattaccttctttggttaatgccgcacaacaaaacattcttagcgtgcacattttgaaccagcaaacaggaaaacccgctgctgacgtgacagtcactcttgaaaagaaggcggataacggctggttacaacttaataccgccaaaacagataaggatggacgaattaaggcactgtggcccgagcaaactgcaactacgggcgattaccgtgtcgtatttaaaaccggggactatttcaagaaacaaaatcttgaaagtttcttccctgagatccccgttgaatttcatattaataaagtgaacgagcattatcatgtgcctttattacttagccaatatgggtattcaacctatcgtggcagttaatgcataaatatgtaaaagcagatctctgctactgttagggaggacactccctgacagattaacagtaaacggctcttgctggctaacgacaaaaaagtgtgatggcttatgaaaaagaatcaatttttaaaagaatcagatgttacggccgagtcggtattctttatgaagcgtcggcaggtgttaaaagcactgggcatcagtgcaactgcactttctttgcctcacgctgcgcatgccgatctgcttagctggtttaaagggaacgatcgcccgcccgcccccgccggaaaagcgctggagttcagcaagcctgccgcctggcaaaataacctgccactgacgccagcagataaagtttccggttataataacttctatgaattcgggctggataaagccgatcccgccgctaatgctggtagcctgaaaaccgatccatggacactgaaaatcagcggcgaagtggcaaaaccattgaccctcgatcatgatgacttaacccgtcgcttcccgctggaagagcgtatttatcgtatgcgctgcgtggaagcgtggtcgatggtggtgccgtggattggttttccgctgcacaaattgctggcgcttgccgaacctaccagcaatgcgaagtatgtcgctttcgaaacaatttatgcaccggaacagatgccaggccagcaggaccgctttatcggcggtgggctgaaatatccttatgtcgaaggattgcgtctcgacgaagcaatgcatccgctcacactgatgaccgtaggtgtttatggcaaggcgttaccgccacaaaatggcgcgccggtgcgactgattgtgccgtggaaatatggctttaaagggattaaatcgatagtcagtattaagctgacccgcgagcgtccgccaaccacctggaatctggcagcgcctgacgaatacggtttttacgccaacgttaatccgtatgttgatcacccgcgctggtcacaggctaccgaacgatttattggttcaggcggcatcctcgatgtacagcgccagccaacgctactgtttaatggttacgccgcccaggtggcatcgctgtatcgtggcctggatttgcgggagaatttctaaatgcgtctgacagcaaaacaggtgacatggctgaaagtttgcctgcatcttgccggattgttgccgtttctctggctggtctgggcgatcaatcacggtggactgggtgccgatccggtgaaagatattcagcattttactggtcgcactgcactgaaatttttgctggcgaccttgttaatcacccctctggcacgctacgcaaaacagccgttattgatacgcactcgccgcctgttaggattatggtgctttgcctgggcgacactgcatttaacaagttacgcattgctggagctgggcgtgaataatctggcgttattaggtaaggagttaattacccggccttatttaacgttaggtattatcagctgggtaattttgcttgctttagcgttcacttcaacccaggcgatgcagcgaaaactcggcaagcactggcaacagttgcataatttcgtctatcttgtcgcgattctggccccaatacattatctgtggtccgtgaagattatttcaccgcagccgctcatctacgctgggctggctgtactgcttttagccttacggtataagaagttgcgttccctttttaaccggttacgcaagcaggttcacaacaaattatctgtataacttcatattgccgacaaagtacgcgttatccctgccggatgtggcgcgagcgccctatccggcatacacagatcgcatcaggttatgtttcgtttgtcatcaacctcaaatcaccaaaataatttattttatttcaataagatagataagtagaactgagaaagccatgctctcgtttcctaagagttgttgcattttgctatatgttacaatataacattacacatcatatacattaactctggaggaaactgttttggcgattcgtctttacaaactggctgttgctttaggtgtctttattgttagcgctcctgccttttcgcatggtcatcactcacacggcaaacccttaacagaggtcgaacaaaaagctgctaatggtgtttttgatgatgccaatgtacaaaaccgaacgctcagtgactgggatggagtctggcaatccgtttatcctttactgcaaagtggcaaacttgaccccgtctttcagaagaaagcggatgcagataaaactaaaacatttgctgaaattaaagattattatcacaaaggttatgcaacagatatcgagatgattggcattgaggacggcattgttgaattccatagaaataatgaaacaacatcgtgtaaatatgattacgatggatacaaaatactcacctataaatcaggcaagaaaggcgttcgttacttattcgaatgtaaagatcctgaaagcaaagcccctaaatatatacaatttagcgatcatataattgcaccacgaaaatcatctcattttcacatttttatgggtaatgattcacagcaatctttattaaatgaaatggaaaactggccaacgtattatccatatcagttgagtagcgaagaagtggtcgaggaaatgatgtctcattgagtattctcatgataacgcctcgatgccgctttagtaagttatcataactgccactggtccatccacaaacgccactgaacgcaagctagctacagacacgctcatcactatgacgtgtctgtatattaataagctaacccgcattgagttaaccaataacggattccatacacaatacggccaacagagaaagatacctgtgctcacgccattgcttatattggctggttacaatatgcactatcaattttttaaataacaaattattaaaaccacatctgtataaggaatttttaaggttcgtgggatagcttgactgtgaaaatcacaggagctacaaaaatgaaccgattctcaaaaactcaaatttatttacattggataacgctgcttttcgttgcaataacctatgccgcgatggaactccgtggctggtttcctaaaggtagtagtacttatctgctgatgcgagaaacacattacaatgcgggtatattcgtttgggtgttaatgttttcacgcctgattataaaacaccgttatagtgatccttctattgtgccaccgccacctgcctggcaaatgaaagcggcttcgctaatgcacatcatgctttatataaccttccttgcacttcctctgctggggattgctttgatggcttacagtggaaaatcgtggagtttccttggtttcaatgtgtctccctttgttaccccaaacagcgaaattaaagcactgataaaaaatattcacgaaacctgggcaaatataggctactttttaatcgcagctcacgctggcgcagcactctttcatcactacattcagaaagataatactctgttacgaatgatgcctcgccgcaaataagtcgatccccttacaaggaaatgtgaaccatggacatcaacgcgtcataaatgtttacgcaagtgcacaatgcaccctttccactatcaacaaggaggagcagaaactgtgtaaatcgtacaatggtaagacttatcaaaaatacaggttaattttggtatttaaaccttttttacttgttagtatgatacaaaggctttcaaaaaagctgcgaaattcaacaactcttggaaattatggactttgtcccgcggctttaatctgacggccgcgttccttttttgactcaattattgaacccttctctacgcaacttcagttcccaccaccaactttgcggcagtttcataggatgaatgtctaaaagaataatggtgagcgataagaaaacgactgaataactgcacattttcgctcgaaagcttcctgtcagatccatagcgaatcaagtgctgaatgtcacagtatcgaacagaaaacagtgacgatctaacccttcaagaatattctacgattgttctgtttaggaaaagcaaggcgggaagtcgggagataagtcattgataaagtggcggagagagggggatttgaacccccggtagagttgcccctactccggttttcgagaccggtccgttcagccgctccggcatctctccgttcagatggttgccatgatgccaggaaatttggcattttaacagtccctgtccgtgcaattttgttcaagtgacgagtttgcgagcaaaacgatgattaagtggccctggaaagtacaagaatcagcacatcaaactgcccttccctggcaggaagcactatcgatcccccttttaacgtgtctgacggaacaggaacaaagcaaattagtcactcttgccgaacgttttttacagcaaaagcggcttgttcctttacagggctttgaactggattcattaagaagctgccggatagcacttctattttgcctacccgttctggagttaggactggaatggctggatggttttcatgaagtcttaatttatcctgcgccatttgtggtcgatgatgaatgggaagacgatatcggtctggtgcataaccaacgtattgttcagtcaggtcagagctggcagcaagggcctatcgttttgaactggttggatatacaagattcttttgatgcttctggttttaacctgattattcatgaagtcgctcataagctggacacccgtaacggcgatcgcgccagcggagttccctttattccgttgcgtgaggttgctggctgggaacacgatcttcatgctgcaatgaacaacattcaggaagaaatcgaattggttggcgagaatgcggcgagcattgatgcttatgcagccagcgatcctgctgaatgttttgccgtactttctgaatatttctttagcgccccagaactttttgctcctcgtttcccttcattgtggcaacgtttctgccaattttatcaacaagatcctttgcagagactgcatcacgctaatgatacagactcgttttcggcgacgaatgttcattaattaacaactttgcagattaattaaccaattgaaatgacttatgaaatttagtgttgacagacaaggtaccgctaagtaatattcgccccgttcacacgattcctctgtagttcagtcggtagaacggcggactgttaatccgtatgtcactggttcgagtccagtcagaggagccaaattctaaaaattcgcttttttagcgcaatgtcactgaccttagttgaacattgttttttaacggatagcgggtttttaacatcttaagcgccctcgacctttatggttgagggcgttttgctatgaacgccatcaccattttcccctcgattataaaacttgagttattcagtagtctcccctcttgcaactcacacccaaaactgcctaacgaaaagttattaattttcaatcatattgctatcagtatttacattttttcgctgtgctagaaagggcgcatttatgttagctcgttcagggaaggtaagcatggctacgaagaagagaagtggagaagaaataaatgaccgacaaatattatgcgggatgggaattaaactacgccgcttaactgcgggtatctgtctgataactcaacttgcgttccctatggctgcggcagcacaaggtgtggtaaacgccgcaacccaacaaccagttcctgcacaaattgccattgcaaatgccaatacggtgccctacacccttggagcgttggaatcggcccaaagcgttgccgaacgtttcggtatttcggtggctgagttacgcaaactcaaccagtttcgtacgtttgctcgaggttttgataatgtccgccagggtgatgaactggatgtcccggcacaagttagtgaaaaaaaattaaccccgccgccgggtaatagcagtgacaacctcgagcaacagatagccagtacttcacagcaaatcgggtctctgctcgccgaagatatgaacagcgagcaagcggcaaatatggcgcgtggatgggcctcttctcaggcttcaggcgcaatgacagactggttaagccgcttcggtaccgcaagaatcacgctgggcgtggatgaagattttagcctgaagaactcccagttcgattttctccatccgtggtatgaaacgcctgataatctctttttcagtcagcatactctccatcgtactgacgagcgtacgcagattaacaacggcttaggttggcgtcatttcactcccacatggatgtcgggcatcaacttctttttcgaccacgatcttagccgttaccactcccgcgccggcattggcgcggagtactggcgcgactatctaaaattaagcagtaacggctatttgcgactgaccaactggcgcagcgcacctgaactggacaacgattatgaagcacgcccggccaatggctgggatgtacgcgcagaaagctggctacccgcctggccgcaccttggcggtaaactggtctatgaacagtattatggcgatgaagtggccctgttcgataaagacgatcggcaaagtaatcctcatgccataaccgctggacttaactatacccccttcccgctgatgaccttcagcgcggagcaacgccagggtaaacagggcgaaaatgacacccgttttgccgtcgattttacctggcaacctggcagcgcaatgcagaaacagcttgacccgaatgaagtcgctgcacggcgtagccttgcaggcagccgttatgatctggtggatcgcaacaacaatatcgttctggaatatcgcaaaaaagaactggttcgcctgaccctgacagaccccgtgacagggaagtcaggagaagtgaaatcactggtttcgtcgctacaaaccaaatatgccctgaaaggctataacgtcgaagccaccgcactggaagctgccggtggcaaagtggtcacaacgggtaaagatattctggttaccctgccggcttaccggttcaccagtacgccagaaaccgataacacctggccgattgaagtcaccgccgaagatgtcaaaggcaatttgtcgaatcgtgaacagagcatggtggtcgttcaggcacctacgctaagccagaaagattcctcggtatcgttaagtacccaaacattgaacgcggattcccattcaaccgccacactgacttttattgcgcatgatgcagcaggtaatcctgttgtcgggctggtgctctcgacgcgtcacgaaggtgttcaggacatcaccctttctgactggaaagataatggtgacggaagctatacccagatcctgaccacaggagcgatgtctggcacgctgacgctgatgccacagctgaatggtgtggatgcggctaaagcccccgccgtggtgaatatcatttctgtttcgtcatcccgaactcactcgtcaattaagattgataaggaccgttatctctccggcaatcctatcgaggtgacggtagaactgagagatgaaaatgacaaacctgttaaggaacaaaaacagcaactgaataacgcagtcagcatcgacaacgtgaaaccaggagtcactacagactggaaagaaaccgcagatggcgtctataaggcgacctataccgcctataccaaaggcagtggacttactgcgaagctattaatgcaaaactggaatgaagatttgcataccgctggatttatcatcgacgccaacccgcagtcagcgaaaattgcgacattatctgccagcaataatggtgtgctcgccaatgagaatgcagcaaacaccgtctcggtcaatgtcgctgatgaaggaagcaacccaatcaatgatcataccgtcacgtttgcggtattaagcggatcggcaacttccttcaacaatcaaaacaccgcaaaaacggatgttaatggtctggcgacttttgatctgaaaagtagtaagcaggaagacaacacggttgaagtcacccttgaaaatggcgtgaaacaaacgttaatcgtcagttttgtcggcgactcgagtactgcgcaggttgatctgcagaagtcgaaaaatgaagtggttgctgacggcaatgacagcgtcacaatgaccgcgaccgtccgggatgcaaaaggcaacctgctcaatgacgtcatggtcactttcaatgttaattcagcagaggcgaaactgagccaaaccgaagtgaatagccacgacgggatcgccacagctacgctgaccagtttgaaaaatggtgattatagggttacggcctctgtgagctctggttcccaggctaatcaacaggtgaattttatcggtgatcaaagtactgctgccctgaccctcagtgtgccttcaggtgatatcaccgtcaccaacacagctccgcaatatatgactgcaaccttgcaggataaaaatggcaacccactaaaagataaagaaatcaccttctctgtgccaaacgacgtcgcaagtaagttctcgattagcaacggaggaaaaggcatgacggatagtaacggggttgcaatcgcctccctgaccggcacgttagcgggcacgcatatgatcatggctcgtctggctaacagcaatgtcagcgatgcacagccaatgacgtttgtggcggataaagacagagcggttgtcgttttgcaaacatcgaaagcggaaatcattgggaatggcgtggatgagacaactctgacagcaacagtgaaagatccgtcgaatcatccggtggcggggataacggtaaacttcaccatgccacaggacgttgcggcaaactttacccttgaaaataacggtattgccatcactcaggccaatggggaagcgcatgtcacgctgaaaggtaaaaaagcgggcacgcatacggttaccgcaacgctgggtaataacaataccagtgattcgcagccggtaacatttgtggcggacaaagcctcggctcaggttgtcctgcagatatcaaaagatgagatcacaggtaatggcgtcgatagcgcaacgctaactgcaacggttaaagatcagttcgacaatgaggtgaataatcttccggtaacattcagctcagcctcttcaggactcaccctgaccccgggagtaagtaataccaacgagtctggcatcgcgcaggccactctcgcaggcgttgcctttggtgagaagacggttactgcatcactggctaataatggtgccagcgacaacaaaactgtgcattttattggcgacacagcggcggcaaaaattatcgagttggcgcctgtcccagacagcataatcgccggtaccccgcagaacagctccggcagcgtcatcaccgccacagtcgttgataataatggctttccggtgaaaggtgtgactgtgaacttcaccagcaacgcagcgacagccgaaatgacgaacggcggtcaagccgtgacgaacgaacagggtaaggctaccgtcacttataccaatacccgctcctcgatagaatcaggagcgagaccggataccgttgaggccagtctggaaaatggtagctccacgcttagcacatcaattaatgtcaacgctgatgcgtctacggcacatctcaccttgctacaggcactttttgatacagtctccgcaggcgagacaaccagtctgtatattgaggtgaaggataattacggcaacggtgtcccccagcaggaggtaaccctcagcgtttcaccaagtgaaggcgtgacccccagtaataacgctatatatactaccaaccacgacggcaatttttacgcaagctttaccgctacaaaagccggggtttatcaattgacggcaaccctcgaaaatggcgattcgatgcaacaaacagtgacctatgtgccgaacgtcgcgaatgctgaaatcacgctggcagcctcgaaggatccggtgattgccgacaataacgatctcacgacactaacagcaacagtcgctgatacagagggcaatgcgatagccaacactgaggtaacatttactctgccggaagatgtgaaggcgaacttcacgctgagcgatggcggtaaagtgattactgatgctgaaggcaaagcgaaagtcacgctgaaaggtacaaaagcaggcgctcatactgttacagcatcgatgactggcggtaagagtgagcagttggtggtgaactttattgcggatacgctcactgcgcaggttaatcttaacgttaccgaggacaattttatcgctaataacgtcgggatgaccaggctgcaggcaacagtgactgatggaaacggcaacccgttagccaatgaggcggtgacattcacgctaccggcagatgtgagcgcaagctttactctcggacaaggcggttccgccattactgatatcaacggcaaggctgaagttacactgagcggtacaaaatccggcacctaccccgtgacagttagcgtgaacaattatggtgtcagtgatacgaaacaggtgactttgattgccgatgctggtaccgcaaaactagcctccttaacctctgtatactcattcgtcgtcagcacgaccgagggcgcaaccatgacggcaagcgtcactgacgctaacggcaacccggtagaaggcataaaagttaatttccgcggaacctccgtcacgctaagcagcaccagcgttgaaacggatgatcggggtttcgctgaaattcttgtgacaagcaccgaggtcggactgaaaacagtttcagcctctctggcagataaacctactgaagtcatctcgcgattactgaatgccagtgcagatgttaattctgcgacgattaccagtctggagataccggaaggtcaggtaatggtcgcacaagacgtagcagttaaagctcacgttaacgaccagtttggcaacccggttgcgcatcaacccgtgacattcagtgcagagccatcctcgcaaatgatcatcagccagaatacggtctctactaatacgcagggtgtagccgaggtcaccatgacgcccgaaagaaacggttcgtatatggtgaaagcatccctgccgaatggagcctcacttgagaaacaactggaggctattgatgaaaaactgacactcacggcgtccagtccgcttatcggtgtctatgcccctacaggcgctactctgacggcaacgctaacctctgcaaatggcactccagtggagggtcaggtcatcaactttagcgtaacgccagaaggggcgacgttaagtggcggaaaagtgagaactaactcttcaggtcaggctccagtcgttttgaccagcaataaagtcggtacatatacggtgactgcatctttccataacggcgtaacaatacagacacagacaaccgtgaaagtcactggcaactcaagcaccgcccatgttgctagctttatcgctgatccatcgactatcgccgccaccaacactgatttaagtaccttaaaggcaacggttgaggatggcagtggtaacctgatcgaaggtctcactgtgtacttcgccttaaaaagcggctctgccacattaacgtcattaacagcggtgaccgatcaaaacggaatcgcgacaacaagcgtgaaaggagcgatgacaggtagcgtcacggtaagcgcagtcacgaccgctggtggaatgcaaacagtagatataacgctggtggctggcccggcagacacctcgcagtccgtccttaagagcaatcggtcatcactgaaaggggactataccgatagtgctgaattacgtcttgttctgcacgatatatcaggcaatccgatcaaagtttctgaagggatggaatttgtgcaatcaggtactaacgtgccctatataaaaattagcgcaattgattacagtctaaatatcaacggtgattacaaagccactgttacaggaggcggagagggtatcgcaacgctgatccctgtattgaatggtgttcatcaagctggtctgagtaccacaatacaattcactcgcgcagaagacaaaataatgagcggtacagtatcagtcaatggtactgacctaccgacaactacattcccttcgcaggggttcaccggggcgtattatcagttgaataatgacaactttgccccaggaaaaacggcggctgattatgagttttcaagctctgcctcctgggtcgatgttgatgctaccggtaaagtgacatttaaaaatgtcggcagcaattcggaaaggattacggcgacgccaaaatcaggaggccctagctatgtatacgaaatccgtgtgaagagttggtgggtgaacgccggcgaggctttcatgatatacagccttgctgaaaatttttgcagcagcaatggctacacgctccccagagcaaactatttaaaccactgtagttcccgaggcatcgggtcactgtacagtgaatggggagatatggggcattacacgactgacgctggttttcaatcaaatatgtattggtcatctagtcccgcaaactcaagcgaacaatacgtagtttccctggcaacaggtgatcaaagcgtatttgaaaagcttgggtttgcttatgcgacatgttataaaaacctgtgattttccgttataatttcttaaagagtgttccattcggggcactcttttttacattccctctacagaactagcccttctctcacagaaaatgaataaataaaaatgcggcaccgccagaatcgcgttcgatgtgactatgatcattttcggtgagtactgctttgatctaaaggctggttttctgtgatgattgaccagcctcagagtattgatgacaccaccgttcataacagatcggcattactatgcataagtactgtctcatattctcgccaaaacactttttaatgcctttgcgaattcatccagacttatattgtcaattttttgcccaacgacgactgactccgagacatcggccattgcgggccatcgcgttttgtaatcagcataaattgcaacaacaggggtattataggcacttgccatatgtaatattgaggtgtcaggagttattgcgatataagcatcttttatgattgctgctgaacgtttaatcgagggtggtaaggataaacggtagacattattataacaatccactaatgccctggctttatcttcacctttgggtccatgaacgatcactattggtatatctgtttcactttaaatttttgctattagattttctgcaatcgataatgaaaatgtacgttcctgcgagctaccttctaaattgaacgcaatgtaagatcctaacgatcgcatttcctcgcgcacctcatcgagtacatcctcacttagtggcaattcatatattggcctgactgctggaaaacccgcctcacgcatcataaatgcccatgtcataggtacgggagcccggagtttctgatccatactggacgcgttcttgcacaaaggggagaagcaattcatggttataccaacaacctgaaaattcgtttttgctttcaactgactgataaataacatcgttttcaggttctttttacgcatcccctcaatgcaaagatccggcgtaccgtattgctgtgttatgttctttgctaaatcttttatttcttttaatgttgcgtgatcctgcatagtcattgtgactaatgttaatttagtctgttcaagtttaagcgcattaaagacttctaaattaattgtcgacgttacaattaaaagatgcttaattttatgcaattcaagcgcccgaataacaggaaagatggccatagcatcgccaatctgatcgggaatatggatgacaacaaagtctgttttttcaatattgaaattataagctttataatcgtagtaactaaatgcaatacgtctcaacaatgatgctaaaaacatacctaacctcgcctccctactggttataatgcaatgcagtctatcagactcatcagggtgccattttgtgcatatgcggacttttatgtttcatatctctaacctgtgggtcctctgcttaatccttaaacaacaccagcaactcctgcgctttcatcttccatcgaatttttcatgttgccgctaatcagccataaaatcatttgcagatgcgctctgtcgaggtagtctcataaggttcgtttatagatcgacggcaatgtgagttaccttttccatactaattataaaaagacagtacaaacaggatcattatggactccacgctcatctccactcgtcccgatgaagggacgctttcgttaagtcgcgcccgacgagctgcgttaggcagcttcgctggtgccgtcgtcgactggtatgattttttactctatggcatcaccgccgcactggtgtttaatcgcgagtttttcccgcaagtaagcccggcgatgggaacgctcgccgcatttgctacctttggcgtcggatttcttttccgtccgctcggcggtgtcattttcggtcactttggcgaccgactgggacgtaagcgcatgttaatgctgaccgtctggatgatgggcatcgcgacagccttgattggtattcttccttcattctcgaccattgggtggtgggcacctattttgctggtgacactgcgtgccattcagggatttgcagtcggcggcgaatggggaggcgcggcgttgctttccgttgaaagtgcaccgaaaaataaaaaagccttttacagtagcggtgtacaagttggctacggtgtaggtttactgctttcaaccggactggtttcattgatcagtatgatgacgactgacgaacagtttttaagctggggctggcgcattcctttcctgtttagcatcgtactggtactgggagcattgtgggtgcgcaatggcatggaggagtccgcggaatttgaacaacagcaacattatcaagctgccgcgaaaaaacgcatcccggttatcgaagcgctgttacgacatcccggtgctttcctgaagattattgcgctacgactgtgcgaattgctgacgatgtacatcgttactgcctttgcacttaattattcaacccagaatatggggctaccgcgcgaacttttccttaatattggtttgctggtaggtggattaagctgcctgacaattccctgttttgcctggcttgccgatcgttttggtcgccgtagggtttatatcacaggtacgttaatcggaacgttgagcgcatttcctttctttatggcgcttgaagcacaatctattttctggatagttttcttctccataatgctggcaaacattgcgcatgacatggtggtgtgtgtgcaacaaccgatgtttaccgaaatgtttggtgccagttatcgctatagtggcgctggagtcggttatcaggttgccagtgtggttggcggtggatttacaccttttattgccgctgcactcatcacttactttgccgggaactggcatagcgtcgccatttatttgctggctggatgcctgatttccgcaatgaccgctttgttgatgaaagacagtcaacgcgcttgatagcctggcgaagatcatccgatcttcgccttacacttttgtttcacatttctgtgacatactatcggatgtgcggtaattgtatggaacaggagacacacatgaataataagggctccggtctgaccccagctcaggcactggataaactcgacgcgctgtatgagcaatctgtagtcgcattacgcaacgccattggcaactatattacaagtggcgaattacctgatgaaaacgcccgcaaacaaggtctttttgtctatccatcactgaccgtaacctgggacggtagcacaaccaatccccccaaaacgcgcgcatttggtcgctttacccacgcaggcagctacaccaccacgattactcgccctactctctttcgttcgtatcttaatgaacaacttacgttgctgtatcaggattatggtgcgcatatctcagtgcaaccctcgcagcatgaaatcccttatccttatgtcatcgatggctctgaattgacacttgatcgctcaatgagcgctgggttaactcgctacttcccgacaacagaactggcgcaaattggcgatgaaactgcagacggcatttatcatccaactgaattctccccgctatcgcattttgatgcgcgccgcgtcgatttttccctcgcacggttgcgccattataccggtacgccagttgaacattttcagccgttcgtcttgtttaccaactacacacgttatgtggatgaattcgttcgttggggatgcagccagatcctcgatcctgatagtccctacattgccctttcttgtgctggcgggaactggatcaccgccgaaaccgaagcgccagaagaagccatttccgaccttgcatggaaaaaacatcagatgccagcatggcatttaattaccgccgatggtcagggtattactctggtgaatattggcgtgggaccgtcaaatgctaaaaccatctgcgatcatctggcagtgctacgcccggatgtctggttgatgattggtcactgtggcggattacgtgaaagtcaggccattggcgattatgtacttgcacacgcttatttacgcgatgaccacgttcttgatgcggttctgccgcccgatattcctattccgagcattgctgaagtgcaacgtgcgctttatgacgccaccaagctggtgagcggcaggcccggtgaggaagtcaaacagcggctacgtactggtactgtggtaaccacagatgacaggaactgggaattacgttactcagcttctgcacttcgttttaacttaagccgggccgtagcaattgatatggaaagtgcaaccattgccgcgcaaggatatcgtttccgcgtgccatacgggacactactgtgtgtttcagataaaccgttgcatggcgagattaaacttcccggccaggctaaccgtttttatgaaggcgctatttccgaacatctgcaaattggcattcgggcgatcgatttgctgcgcgcagaaggcgaccgactgcattcgcgtaaattacgaacctttaatgagccgccgttccgataataagttctgaaccttcttatcagaaatagatgtgaaggagtaagtaagacacctggcaaatagcctgcaataatcgtgggctgtttgcttccttgggcggatacgagttttattatcgtcttaatgatttccacatattaaaagcaagtatgctttcaaaacacaattataaaaaatcccgccaacaatataagtttttataaaattaaatataagattatggctttagaatatttttatttctaatagacgagatttttcctgttatgatataatatgctgaattaacacatgttaacgatttaccagtaatgtaaataaattttcgaggagatcattccagtgggacgtaaatgggccaatattgttgctaaaaaaacggctaaagacggtgcaacgtctaaaatttatgcaaaattcggtgtagaaatctatgctgctgctaaacaaggtgaacccgatccagaattaaacacatctttaaaattcgttattgaacgtgcaaagcaggcacaagttccaaagcacgttattgataaagcaattgataaagccaaaggcggcggagatgaaacgttcgtgcagggacgttatgaaggctttggtcctaatggctcaatgattatcgccgagacattgacttcaaatgttaaccgtacgattgctaacgttcgcacaattttcaataaaaaaggcggcaatatcggagcggcaggttctgtcagctatatgtttgacaatacgggtgtgattgtatttaaagggacagaccctgaccatatttttgaaattttacttgaagctgaagttgatgttcgtgatgtgactgaagaagaaggtaacattgttatttatactgaacctactgaccttcataaaggaatcgcggctctaaaagcagctggaatcactgagttctcaacaacagaattagaaatgattgctcaatctgaagttgagctttccccagaagatttagaaatctttgaagggcttgttgatgcccttgaagatgacgacgatgtacaaaaagtttatcataacgtcgcaaatctctaattatcttttaaagaaatctgtctttacggcagatttctttaatctcatataattcttataaaaaatataatattcaactcgtcatattgattatacccccccgttcccagagaaataatatttattaaaattccagttcttctttttctgattacagaaggcaaagtggcaattacgcatagtttcccgataaagacgcgatagcgacatcccgcataaggcatttttctctttatctttgtacggtacttcatggaacagagtttttgaccttgcgaatcgtgatgtctgttggggagggacaatttgctcactgaagcgtgagactcgattaagcgcacgaaacacagaaatcaaaaaacccggtcacttttttacaaggtaaccgggtaaaaataatttttattttttaactgttttgagactcatagagatgtctcaaaactaaaatttggctcctctgactggactcgaaccagtgacatacggattaacagtccgccgttctaccgactgaactacagaggaatcgtgagaacgaggcgaatattagcgatgcccacccacaatgtcaaagcctgttttttaaatttgaaatcgtttgctgaaataatctgcattttgtcgtttattccgacacaactggctttttttcacacttttgcggctcgggtcgagggtatttccatagccaacgtccagtaaccattcgccagtaaaacagcacggcccgcacagcccagtcggcaaacattcccatccagacaccaaccacaccccagccaagcatgattcccagcacataaccgactacaacccgacaaccccacatgctcaacatcgaaacccacatggcgtaacgggcatcacgagcacctttaaatccagcgggtagcacccatgaggcggaccaaataggcataaataaagcatttagccaaatcagaatcacaacgacatgtttaacctgtggatcctgggtgtaaaacgatgccataaccccggcaaagggagccgttagccaggcgatggccgttaatccaagagtggaaagccagaacacatgccgcaactgaatctctgcttgcgctatctgccctacccccaaccttcggcctgtaatgatcgtagaagcagagccgagcgcacttccgggtaagttgataagagccgcaattgaaaacgcgataaaatttccggcaataacactggtccccatcccggcaacgaacatttgggttaataaccgaccactggtaaataacactgattcgacactcgcgggaataccaatccccatgacttcccagataatgctaaaattcagcggtttaaaatagctctttaacgaaatccttagcgcaggattaaaaccaatcgccagcacccacaaaattgcaactgcgccaatataacgagaaatggttaaacccagccctgccccgacaaatcccagtcccggccaggagaaaaggccgtaaatcaatatgccgctaataataatattaagaatattcaggctaccgttaatcaatagcggtattttcgtattccctgcaccacgaagtgccccgctaccaataagagtgatggcagctgctggataactgagtaccgtcagctccagataagtcaacgccagtgctttaacttctgtcgtggcatcacccgcgacgaaatcaataatttgttcgccaaaatgatgaataagcgttgccaacagtacggcaaacaacgtcatgatcaccaatgactgccgcgtcgccaccctcgctcgtcgtcgatcccgcttaccgagactaaatgccacaacgacagtagtaccaagatcgatagcagcaaaaaaagccataatgaccatattgaagctgtccgccaatcccacgccggccatcgcatcttttcccagccagctgaccagaaaagtgctcagaacccccatcaacaggacacaggcattctccatgaagataggaacagcaagcggggttatctcgcgccagaacaacactttgtagctcttgcgtttagcgtgccagcgagtgccgtgaacaacctggcgtaaagcagaggagatattcaaagccgaccttaattgcagaaagtgaaaccacatttcaaataatgagggagaatcagcaaagctgcaaagattttcgccaacaaattgtctgcaaatgcaacaaactgttgatagaaacggcaaacagttggggaatttaaaaatcgggtttgacaaaagatttttcgccgttaagatgtgcctcaacaacgattcctctgtagttcagtcggtagaacggcggactgttaatccgtatgtcactggttcgagtccagtcagaggagccaaattcctgaaaagcccgcttttatagcgggatttttgctatatctgataatcaatttcctcttcactgctttccatcacctgccgcttgatatcctcaactgacagtcctgcattacaaagttccagaaagcgccagacatagttacgctgaagttgtcctcgcttcagtcccaaccagacagtattagcatcaaaaagatgccgcgtatccaggcggattaaattctcttcctcttgttcgccactggattgctcggcaactaatccgatcccaagcccaagagcaacataggttttaatgacatcagaatcctgcgcacttaatacaatatctgccagcaaacctttgcgggcaaatgcgtcatcaatacgtgagcgccccgtaatcccctgtcggtaagtgattaacggccacttcgctattgattccagcgtcaatggtgaaatttgcgtcaagggatgatcgtgtggaacaagcaaactatggtgccaacgaaaccacgggaaggcgacgagctgcgggtcattactcaaacgctcgctggcgataccaatatcagcttcgccattttgcaacaatgtcgcaatttcctgtggcgtcccctggattagctcgagccgaacctccgggaaaagttcgcgaaaagctttaatgacctctggcaagctataacgtgcctgagtatgcgtcgttgcaatagtgagaacgccagacgtatcgttggtaaacaggtctgcaagccgacgaacattactggcttcattcagaatacgttctgcaatgaccagtaatgctttgcccggttcagtcatgcccagcagtcgcttacctcgtcgaacaaatatttcgatgccaagttcatcctccagttcccgaatatgacggctgacgcctgactgtgaggtaaaaagcatattcgcaacctctgtcaggttgtaatcctgacgtgcagcctcgcggattatctttagttgttggaaattcacggtaaactccgggcagttcagatttcccgttattgttaaagtctaatgcccggcataacaaataataaaaacccgcatcttattccatcccgatataacacttagctcaccaattgccactgccttttttccatcactggagaactaatcactgacattaacaactctttcactgcctgtgcctgtggcgataagttcgctctggcgggtaaatttaatgacaaagagagactcatggaaggagtggtaatgcgtgacatccacccatttactgcgccacataacgaacgcgcggccgattcgggtaatactgcaacgcccatgccgctggcaatcgctgcggtaagcgtggcaatagactcaatttcaccaataacttttgccgtgagtcgccgtagggaaaaagcctcatcaacacgaagtctaatagcactgtaatcactggggagaaagaggttcatttgcgcaatagcattcacatcaacgctttgccccgggcaatcttgagttcctaccagaaaaagatcttctttcagcaaagcctgactggatacaccagccacaggggaatgctcataaatcaccgccatatcgagttggtgatttatcaatttttcgttaagcactgcaccactattttcatgaagatagataacgatctccggaaattcagcgcgaaccgcctgtaataagggcatggtgatggatgacgcagcggttcctggtgcaaagccaatcgagacttgccccgataatgcctgaccaacgttatgcaccgccagttgggcctgttcacactgacgtaaaatggcccgcgcatgggtatagagaatttttccggcgtctgttggtgtaacgccccgctttgtacggatcaaaagttgttgatttaactcaccttccagtgtggcaacctgctggctgagcgctggttgtgcgatatgcaatacttcagcagcctgggtcaggctaccaatatctacaatttttacgaagtatttcaggcgtctgaagttcatgttgcctccggtttttaagaatcggcccaagtgccgccattacttacaaccagattgcaagatgcttgccagttttattttggtgttgatgtacaagctaaccaactgtcaaataagagattatgatagattcgtcatttgctcctttaatcagctgtcgcgttcccctgccctataaaaggagggtatgcaccacgatggttcattacccaataagattgaaagctcaccactttgttgaaattgacagcaaacaaacaaaaaaatgcatttcaccctttgacatcaccatgcactgccattaatatgcgccccgttcacacgattcctctgtagttcagtcggtagaacggcggactgttaatccgtatgtcactggttcgagtccagtcagaggagccaaattcaaaaaagcctgctttctagcaggctttttgctttctaattaccaacgctcttaaaacatctgtcttgaaccagaactaatttgcacaggcattcccgatcgacgttgcaacgcagcatttgcgcgatttacatcaacttcttgcccgttgataaacgcccgcaaagatggggttaccggcaatggcacttttcggtcagactcatattctgcacgattgcgcgacaatggctcatgaacttccagccagttcgagccatctggttcagtggtgtattttactggctggtcgataatttgcacacgcgtcccaacaggaacattatcaaacagatatttgatatcgtcattgcgcagacgaatacagccctgacttacccggagcccaataccaaaattggcattggtaccatggatggcatacaacctgccaatataaatcgcgtacagccccatgggattatcggggcccgcaggaacaaatgcgggcaaactctcccctcgtttcgcatattcgcgccgagtgttcggcgttggcgtccaggttggagcttcttgtttacgttcaacggtagtcacccagttacgcggggtttctcgcccagcctggccgataccaataggaaagacttccacagtattactgtctggtgggtagtaataaagacgcatctcagcgacgttaacaacaatccctttacgaacagtgtcgggcaaaatcagttgctgcggaatggtgagttgcgagccagacttcggcaaaaaaacatcagcgcccgggttcgcttccagcatgttacttaacccttgcccgtattgtgcggcaaaagtctccagcggctgggtattgtgatcaggaacagttacagtaaacgactgccccactaaacggctaccctctggaggtaatggataagttaccgccaggctagtatggctggcaaaaagcagagcaaatgagcaaagaatatttacacgacgcatcatgtccctttcctatgtcgcgaaagctatccgttaagtatagcttttatcagacttttcgtttttaactgttcaaatcagaagtcgtattccccggtagaacaatattactggcagcaagttcgcccatgttgttgtatatcgcacaggcagcttcgatgatgggcatcgccagagctgcgccactcccctcacctaaacgcatctccatattgagataaggctccagccccaaatgcgagagcgctatacgcgcgcctttttctgccgacaggtgagaaggaatgagatacggtttgatcgcaggagacatctggcaggctgcgagcgcagcagcataagaaagaaatccatccagcaacacgggtaaaccgcaggaagcagcacctaacatcactccagctattccgaccaaatcaaatccacccacttttgccaggacatcaacaccatcctgaggatttggttgattcaacgtaatcgcccgacgcacaacatcaattttattagccagtttatctgtcggcaggtttgcgccaatcccaaccacttcttcaggatcccggccagtgattgtgctgactattgctgctgccggtgtcgtgtttgccatccccagttcacctacaccaaacagcgtgacaccgttttttgccagctcctgcgtataacatatgacgtccaaaagcaacttttcagcctgacggcgactcattgccggagctgaagcaatattgccgctacctcgtgcgacacgcatgttgataagcccggggataggctcagcagtatcaataccaacatcaattacgtggacgttagcgcccgcttgttctgccagcacacacacgccggttgttccacgggtcatattttcagcctgtatggctgtcacttcttttggagaaatagcgaccccttcctcccagacgccgtgatcggcacacataaccagtaccgcttttttgcccacatgcggtatgccattcaaccccggcattcctgccagttgtatggcaagcacctccagctttcccaggctaccaacaggtttgagtaacccgtcaatatgccgttgtgcacgcgacatagcggtagaatcgatggctgggatcgtattcagtaaatcggcaagtatttgcatctcacgtctctttatagcagtgccagcaggaagaccagttcaccaagctctatggctgctcccagcgtatcgcccgtttgcccgcccagcgtacgtttgagaagctgaccgaggatgaaaatcgccaccatcgtcaccaccatagcagccacaccatgcatacccggcaataatacggcagcaaaaatagcggctaagccgagtgtgacgcaggtttgtcgcccatcaattttgccaatgaacacattgccaagcccttcttcccgcgcataacgatgacgatacatcaataatgcggcagtcccgcggctgaccgcacatgctgccgccagcgatgcaaggatcgattcgccacgcagagccaactcgcttaacaccagaatctttgccagtaccacaaaaatcaatgccagaccgccgtgggtgcctaaacggctatcacgcatgatttccaacatgcgatcgcggctacgtgcagaaaatacgccatcacaggtatcagcgaggccgtccagatggaatcccccggtcatcagcaccagcacaagtacgctaaacagtgccgccagtggtgcgccacaccatgcctgcagcaccatgaagaccagcccgctaatcgcgccaagcaataatccaatcaaaggaaaagtaataataccgcgagaataatgctcgaaatccagtccctgggaccagcgacgcggtacaggcagacgcgtaataaatgagagcatcgcccaaaataatttactcatttgatttttactccaatacccgaaaccaccagccatacttcatttgccgcagcggccaactgctgatttacccgcccggcaatatcacgaaaatgtcgtgccagacgactctccggcacaatccccattcccacttcgttagtcactaatacaacctttgcggggcaacgttggcaggcagcaatcaacgactgaatctcagcattaatcgcctgttccatcgcctgataatcccattcatcagggtctttatcgccgccataatcaaacaacagattagtcaccattgtggtaacgcattcaagcaacacaacctcattcgggttaatgtctgcatgaattaattcatcaagatgttgccagcgctccactgtgcgccagtgctccgggcggccttgccgatgatgttctatccgtgcagccatctcatcatcaaggatttgcgaggtagcgatatacagaacctgtgaagagtccccaataagcgcctctgcgtggcgactcttcccgctccgtgcgccccccgtcaccaaaatcatcataccgactcctgattcaaatgtatgatggtattcattgaacagaacaatggatcccccaccgttgctgaccgcaaaacatttacgcgattaatactgcgcgtaatataattaaaaatccagcattctcaatccattacgaaataagatggcattacggaatagccagactttctcgtgttaacgtccgacaaaatgcgtcattgacagcggtttctgtggattgacacatttcattcagataatgaattaatgctactgccggaacaaccagcaaacgggcattgtgttctgaaatccaggctattgattcaacgtcagcgacagatctgcgctgtaaaagaacttgtaaaacaacgtaatagaattatccggaatggtggcgactatgcactagggaaggtgcgaataagtggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccttggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgactaggctgtgggtcaggccgctcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttccatggctccagatgacaaacatgatctcatatcagggacttgttcgcaccttccctagaacaccacaatttcgctctctcggtaaggcactgtcacagcattcaacagaatgtgacttgccagatttattagcgccaccagatgtttaaccgggtaaccacgacccagtcggggatatattccatcttctcgctgacatcatcaagaataaaaaggtttatcacactcagagcaacgttcttcagcaggcgggataattcttcaacatttagaagatgtgttattaaaggcatacaaactggacgtattgtattttcttttggtggttgacctaaggtagcagtttatcctgatgcgctgagatttctgtaatatctacgtcaacattctcctcgaatagaaaatgcagccccggcaagtgattcacattttttaacaaaacgttgttagcgtgccattttcagaagctctccaagaaagcgaattcttttctcaaattctgcattctcagacacagctttctactccatggtaatggcccaaatacgaagttgctcaggatcattagtggtgctgagaagttaaataaccatgcggagtaccactcgtcatcacgtatttatatatcatgaagctattgttgtgttttgtacatcagtagatatattctgatatactccttttgctagacataacctttcacctgcttgcaaagcttctgtgttctgacattgccaaattgttgcaattctgtatccagccttctttcagtcatagcttcgggccgcgataagactcactgatctgaccctgattcctcttgcagactttatagaccaattaaaatgcagtttctgcaggtcaacgtctgaccatcattgtcatcactctggccattagagtaaccttctgcattcatccttttgtaaaaagtttatattagtatcagcaattaaccggacctgatactgatatgagtcttaccgcatatacggtcaatttcagcaattaattacattatccacgccaaagtatttgtcatcacaatgatggtaccttctttcagacaccattttttcaactccgttttccacggaccgcactcttatgtcaagagtgcggtccgtggatacaaccagagaccgactgacacgagtcagaggaaacgacggatatgttcagtcgtaaaatatctatcaaaaaacatgattaaggtcaaaaatgtttgatatttacaatttatgaagatgacaataattatagatatatgagaacataaatgaaaataattatcattacagtaatcatttgtactttgtattaatgagggatgaaatgttatataatataccttgtcgaatttatatcctttccactctgtcattatgcatttctgggatagtttctactgcaaccgcaacttcttcagaaacaaaaatcagcaacgaagagacgctcgtcgtgaccacgaatcgttcggcaagcaacctttgggaaagcccggcgactatacaggttattgaccaacaaacattgcagaactccaccaatgcctccatagccgataatttgcaggacatccccggagtagagataacagacaactccttggcaggccgtaaacaaatccgcattcgtggctggatttgcccctatatttccagacatctgttatcacttaacccattacaagcccgctgccgcagatattcccgtggcgagcgataacccagcgcactatgcggatgccattcgttataatgctcgaacgcctctgcaaggttctttgctgccgttaacccgtctggtttgggcatgatactgatgtagtcacgctttatcgttttcacgaagctctctgctattccgttactctccggactccgcaccgccgtgttcttcggttcaagtcccaacatccgggcgaactggcgtgtttcattagcccggtagcatgaaccattatccgtcagccactccactggagacgacggaagatcgttgccgaagcggcgttccaccgctcccagcatgacgtcctgtactgtttcactgttgaagccgccggtagtgaccgcccagtgcagtgcctcacgatcacagcagtccagcgcgaacgtgacacgcagtctctctccgttatcacagcagaactcgaacccgtcagagcaccatcgctgattgctttctttcacggccactctgcctgtatgtgcccgtttcgatggcggtacagcaggttttcgctcaagcaacagcgcattctggcgcatgatccggtaaacacgtttggcattgatcgcaggcataccatcaagttctgcctgtctgcgaagcagcgcccatacccgacgataaccatacgttggcagctctccgataacatggtgtatacggagaagcacatccgtatcatcagtgtgacgactgcggcggccatccatccagtcatcggttcgtctgagaatgacgtgcaactgcgcacgcgacacccggagacaacggctgactaagcttactccccatccccgggcaataagggcgcgtgcgctatccacttttttgcccgtccatattcaacggcttctttgaggagttcattttccatcgttttcttgccgagcaggcgctggagttctttaatctgcttcatggcggcagcaagttcagaggcaggaacaacctgttctccggcggcgacagcagtaagacttccttcctggtattgcttacgccagagaaataactggctggctgctacaccatgttgccgggcaacgagggagaccgtcatccccggttcaaagctctgctgaacaattgcgatcttttcctgtgtggtacgccgtctgcgtttctccggccctaagacatcaatcatctgttctccaatgactagtctaaaaactagtattaagactatcacttatttaagtgatattggttgtctggagattcagggggccagtctagtggcgaagcatcctcccgtgttttaattctcattgatggtcaggaggtaacttatcagcgcgccggagataattatggtgtgggactgttgatagatgagtctgcgctggagcgtgttgaggtagtgaaaggtccatattccgtactgtacggttcacaggcaattggcggtattgttaacttcatcaccaaaaagggtgaatctccggactccctatatcacttaaattgatacaactttttagagtagtcattagtgaacagataattgataactcagaaccagtaaaatgcaaaagacgcaccacgctgggaaaatcgctgctattcagcagagttttgtatcgagaatggtggccagccacttattgctctcgcgtaagcgggtaccgtgacattctgcctgaacttgacctggtactgtggctgattaaagccgatgaccgtgccctgtctgtggatgagtatttctggcgacacatcctgcagtgcggacatcagcaggtgctgtttgtggtgacgcaggccgacaaaacggagccctgccatgaatgggatatggccggtattcagccttctcctgcacaggcacagaatattcgcgaaaaaacggaggcggtattccgtctgttccggcccgtacatccggttgtggccgtatcggcccgcaccggctgggaactggatacgctggtcagtgcgctcatgacagcgcttcccgaccatgccgccagtcccctgatgacccgactgcaggacgagctgcgcacggaatctgtccggtctcaggcccgtgaacagtttaccggtgcggtggaccggatatttgacacggcggagagcgtctgtattgcctctgttgcacgcacggttctgcgtgccgtccgtgacacggtggtctctgttgcccgtgcggtatggaactggattttcttctgaacctgtcgtgactgatgccctccctgactctgagtctgctcacaaaagcactgttttcgttactgtctctcttgtccgtgcaatagctcaataatagaataaaacgatcaatatctattttatcgatcgtttatatcgatcgataagctaataataacctttgtcagtaacatgcacagatacgtacagaaagacattcagggaacaacagaaccacaattcagaaactcccacagccggacctccggcactgtaaccctttacctgccggtatccacgtttgtgggtaccggcttttttattcaccctcaatctaaggaaaagctgatgaaacgacatctgaatacctgctacaggctggtatggaatcacatgacgggcgctttcgtggttgcctccgaactggcccgcgcacggggtaaacgtggcggtgtggcggttgcactgtctcttgccgcagtcacgtcactcccggtgctggctgctgacatcgttgtgcacccgggagaaaccgtgaacggcggaacactggcaaatcatgacaaccagattgtcttcggtacgaccaacggaatgaccatcagtaccgggctggagtatgggccggataacgaggccaataccggcgggcaatgggtacaggatggcggaacagccaacaaaacgactgtcaccagtggtggtcttcagagagtgaaccccggtggaagtgtctcagacacggttatcagtgccggaggcggacagagccttcagggacgggctgtgaacaccacgctgaatggtggcgaacagtggatgcatgagggggcgatagccacaggaaccgtcattaatgataagggctggcaggtcgtcaagcccggtacagtggcaacggataccgttgttaataccggggcggaagggggaccggatgcagaaaacggtgataccgggcagtttgttcgcggggatgccgtacgcacaaccatcaataaaaacggtcgccagattgtgagagctgaaggaacggcaaataccactgtggtttatgccggcggcgaccagactgtacatggtcacgcactggataccacgctgaatgggggataccagtatgtgcacaacggcggtacagcgtctgacactgttgtgaacagtgacggctggcagattgtcaaaaacgggggtgtggccgggaataccaccgttaatcagaagggcagactgcaggtggacgccggtggtacagccacgaatgtcaccctgaagcagggcggcgcactggttaccagtacggctgcaaccgttaccggcataaaccgcctgggagcattctctgttgtggagggtaaagctgataatgtcgtactggaaaatggcggacgcctggatgtgctgaccggacacacagccactaatacccgcgtggatgatggcggaacgctggatgtccgcaacggtggcaccgccaccaccgtatccatgggaaatggcggtgtactgctggccgattccggtgccgctgtcagtggtacccggagcgacggaaaggcattcagtatcggaggcggtcaggcggatgccctgatgctggaaaaaggcagttcattcacgctgaacgccggtgatacggccacggataccacggtaaatggcggactgttcaccgccaggggcggcacactggcgggcaccaccacgctgaataacggcgccatacttaccctttccgggaagacggtgaacaacgataccctgaccatccgtgaaggcgatgcactcctgcagggaggctctctcaccggtaacggcagcgtggaaaaatcaggaagtggcacactcactgtcagcaacaccacactcacccagaaagccgtcaacctgaatgaaggcacgctgacgctgaacgacagtaccgtcaccacggatgtcattgctcagcgcggtacagccctgaagctgaccggcagcactgtgctgaacggtgccattgaccccacgaatgtcactctcgcctccggtgccacctggaatatccccgataacgccacggtgcagtcggtggtggatgacctcagccatgccggacagattcatttcacctccacccgcacagggaagttcgtaccggcaaccctgaaagtgaaaaacctgaacggacagaatggcaccatcagcctgcgtgtacgcccggatatggcacagaacaatgctgacagactggtcattgacggcggcagggcaaccggaaaaaccatcctgaacctggtgaacgccggcaacagtgcgtcggggctggcgaccagcggtaagggtattcaggtggtggaagccattaacggtgccaccacggaggaaggggcctttgtccaggggaacaggctgcaggccggtgcctttaactactccctcaaccgggacagtgatgagagctggtatctgcgcagtgaaaatgcttatcgtgcagaagtccccctgtatgcctccatgctgacacaggcaatggactatgaccggattgtggcaggctcccgcagccatcagaccggtgtaaatggtgaaaacaacagcgtccgtctcagcattcagggcggtcatctcggtcacgataacaatggcggtattgcccgtggggccacgccggaaagcagcggcagctatggattcgtccgtctggagggtgacctgatgagaacagaggttgccggtatgtctgtgaccgcgggggtatatggtgctgctggccattcttccgttgatgttaaggatgatgacggctcccgtgccggcacggtccgggatgatgccggcagcctgggcggatacctgaatctggtacacacgtcctccggcctgtgggctgacattgtggcacagggaacccgccacagcatgaaagcgtcatcggacaataacgacttccgcgcccggggctggggctggctgggctcactggaaaccggtctgcccttcagtatcactgacaacctgatgctggagccacaactgcagtatacctggcagggactttccctggatgacggtaaggacaacgccggttatgtgaagttcgggcatggcagtgcacaacatgtgcgtgccggtttccgtctgggcagccacaacgatatgacctttggcgaaggcacctcatcccgtgcccccctgcgtgacagtgcaaaacacagtgtgagtgaattaccggtgaactggtgggtacagccttctgttatccgcaccttcagctcccggggagatatgcgtgtggggacttccactgcaggcagcgggatgacgttctctccctcacagaatggcacatcactggacctgcaggccggactggaagcccgtgtccgggaaaatatcaccctgggcgttcaggccggttatgcccacagcgtcagcggcagcagcgctgaagggtataacggtcaggccacactgaatgtgaccttctgacagaaccatcgcctctctgtggtcccggtcatcatgaccgggacccggaccggcgcaacggatcttcaacgccacattcgctggcattaacaataacatgatattcatcacggagtgactatgttacagatagtcggcgcgctgatcctgctgatcgcaggatttgccattcttcgccttttgttcagagcattaatcagcacggcttctgcgctggcagggctcatattgctgtgtctgttcggcccggccttactggctggctatatcaccgaacgcataacccggttgttccatattcgctggctggcaggcgtatttctgacgattgccggaatgatcatcagcttcatgtggggacttgatggtaaacatatcgcgctggaggctcacacctttgactctgtgaaatttattctgaccaccgctctcgccggtggtctgctggctgttcccctgcagatcaaaaacattcagcagaacgggatcacaccagaagatatcagcaaggaaattaacgggtattactgctgtttttatactgcctttttccttatggcgtgttctgcatgcgcaccattgatcgcgttacagtacgatatttcaccgtcactgatgtggtggggcgggttgttgtactggctggctgcattagtgacgctgctatgggcggccagccagatccaggcgctgaaaaaactgacctgtgccatcagccagacactggaagaacaaccggtgctcaacagtaaatcgtggctgaccagtttgcaaaacgattacagccttcctgactcactgacggagcgcatctggctgacgctcatttctcaacggatttcccggggagagctgagggaatttgaactggcagacggaaactggttactgaacaatgcctggtatgaaagaaacatggcagggtttaacgaacagttgaaagagaacctgtcattcacacctgatgaactgaaaacgctcttccggaaccgcctgaatttatcaccggaagcgaatgacgattttctcgatcgttgcctggacggcggtgactggtatcccttttcagaaggtcgccgttttgtatcattccatcacgtggatgagcttcgtatctgtgcctcctgcgggctgacagaagtacatcatgccccggaaaatcataagccggatccggaatggtactgctcctctctttgtcgcgaaacagaaacactgtgtcaggaaatttatgaacgcccttacaacagctttatttccgatgcaacggcgaatggtctgattctcatgaaactgccggaaacctggagtacaaatgagaaaatgtttgcttccggagggcagggacatgggtttgccgctgaacggggaaaccatattgtcgacagagtccgtctgaaaaacgcacggatcctcggtgataataatgccagaaatggagcagacagactggtcagcggaacagaaatccagacgaaatattgttcaactgcagcccgtagcgtcggtgcggcattcgacggacaaaacggacagtatcgttacatgggaaataatggccccatgcaactggaagtcccccgtgatcagtatgccggcgctgttgaaaccatgaggaataagatccgcgaaggtaaagtagaggagagatgacgcccggcgagcgcagcctcattcaacgggccctgaaaaccctggaccgccatcttcatgaacccggcgtggccttcacctccacccgtgcagcacgggaatggctgattctgaacatggcgggactggagcgtgaagaattccgggtgctgtatctgaacaaccagaatcagctgattgccggtgaaaccctcttcaccggcaccatcaaccgcacggaagtccatccccgggaagtgattaaacgcgccctgtaccacaatgccgctgccgtggtactggcacacaatcacccgtccggtgaagtcacacccagtaaggcagaccggcttatcaccgaacgtctggtacaggcactgggcctggtggatatccgggtgccggaccatctgatagtcggtggcaaccaggttttctcctttgccgaacatggtctgctttaacccttcacaaccacatcacacctgttttcacttttatcttctgtcttcagaggtatcccattatgaaaattatcacccgtggtgaagccatgcgtattcaccaacaacatccgacatcccgtctttttccgttctgtaccggtaaataccgctggcacggcagtgctgaagcgtataccggtcgtgaagtgcaggatattcccggtgtgctggccgtgtttgctgaacgccgtaaggacagttttggtccgtatgtccggctgatgagcgtcaccctgaactgagtgggaattctgatgagcagaattatcgccactaccggaccattcttagccgattttctgtaaggattttatcgtgtcagacacactccccgggacaacacttcccgacgacaatcacgaccgcccctggtgggggctgccctgcaccgtgacgccctgtttcggggcacgtctggtgcaggagggtaaccggttgcattaccttgccgaccgcgccggtatcagaggcctgttcagcgatgcagatgcgtaccacctggaccaggcctttccgctgctgatgaaacaactggaactcatgctcaccagcggtgaactgaatccccgccatcagcataccgtcacgctgtatgcaaaagggctgacctgcaaagccgataccctcagcagttgtgattacgtttatctggctgtttatccgacgcccgaaatgaaaaattaactctccagaatagccttctgctacggcctggtgttttcaccacgccacttttccatttttatatctgcatatcaggaaaatcttcagtatgaaaacattacctgtattacccgggcaggcggccagttctcgcccgtctcctgttgaaatctggcagatactgctgtcccgactgctggaccagcactatggcctcacactgaatgacacaccttttgccgatgaacgtgtgattgagcagcatattgaggcaggcatttcactgtgtgatgcggtgaactttctcgtggaaaaatacgcgctggtgcgtaccgaccagccgggattcagcgcctgtacccgctctcagttaataaacagcatcgatatcctccgggctcgcagggcgaccggcctgatgacccgcgacaattacagaacggtaaataacattaccctgggtaagtatccggaggcgaaatgatgacactggaagccgacagcgttaacgtacaggcgctggatatggggcacattgtcgttgacattgatggtgttaatatcactgaactgattaataaggccgctgaaaacggttattcactccgcgtggtggatgaccgtgactctaccgaaacaccggcaacttatgccagccctcaccagttgctgtaagacaatgcagtgatacagggtatagtgccattaaccacagaaacagcactgttgtcctgtattaagcaggcaagagaagatgtccttaccctgcgccatctgcagcttctgcaccagaaccggtgaatctcactcaacaggcttcatttctcctgacgccagcctgaatacagctggcgttttcatttataaacagaaaggaaaaccgataataatggaatggacgccccgaccatgaagcaacggtaggatattactgataaaccttccagtggaggtgcgttatggccgttttaacgattagcattgacctgacaaaaaatgaattccaaatccacggtctgggtaggaacagaaaaatctaagctcagaaaacggattaaagtaagcgtcaacggagcaccgtattgacgcttatttattggtgagaactacgttccatggcaggagttcgtcaacacggttggagggccattccggcagtatgctcagaatatggcgcagatacgcttccggatcgataccgttcagacggcaggtgcctgcttttctggcaacaagcaggaatctcagcgctgaagcaggaattagaggtaaaaacgccctaccgggccatgaatcacccggtcattggagtagtaaccaaagcagatttagccagcatggaacaaatatctttggtgaaaagttggttacgggaagctggagcgcacaacgtgttagtaaccagtgcagttaataacaatggagttacagaactttttgccttgctgcatacagaagaaggctgttgttaatttcgattggttctcggatgagaatgatgacggtgatacacagataagaatcaatgagcaatgagggttgccgggcaaccctcattgaataaaacgggaattacttcgcttcgccgtttttcatttcgcccatagctttcagctttttggagatatcgcggcgttctttggagagctcggcatttttgatgatgtaatcgtcaacgcgatcttcatagtcacctttcatgctggcgatgatgccctggattgcttcaacgctcatccccggcttgatgtaatcgctcaggttgtccagcagcaggacgcgcttctggttgtcacggatctttttctcaacgtcctgaatttcacgttgcagtttgttcttacgacggaacagacgaacaaattccagtacgtcctggaatgaaggcttggtagtttccatttttatacccctgataatgtgagagtcggattcgtttaagcaaccgctattcgttagggccaacattactcatagctgccgcagatgacaatgcttttatcccttttcactatcataccctttatccttgctgaatcgaagcagcagcaagatgattctgaagttcaggaattatttgcgcaaggcccggcaaatcagattcgatagcaactcaagctgatgcgccgtttccatgttcagccacacataaccatagattggtgtttccacaaccttcaggtcatggtggttattgagcaactgacgcagctcttccacagcatcgttcaatttttccgtattggcaaaaaccggctgcggattaccttcgtacagcgcatgaacaaggctcagcagtatttgctgcatcatgtgctgggtatcacgaagtttttgcgcgttcaataacacgaaatggctggggcgcgtggcccagtatgcattgatttgcaactccagcatacaaaccagattgcggttaatggtctggataccttcatatatcgattttggaatacgggtttctttgctggcgggcgcaatcagtccacgcattttcacggcatcggtcaggagtttttgtagatggctttccagacgtgggcgttcgagtaagttcggtgagaatgcagattgatagacccgattatactcggtcagacttttcgccagttgaatgcgccagtggatgaacgcccgttgtggccagataccggtaaacaacattgccagtaaagagccgaggatcacatcgccgcttcgccataacgccgtatcaatttcacctgtcggggaacccacaacaattgccagcgtcaccccaatcaataaaccttgatacggtttcttgcccagcgccagccaaccgcaaaggaacatggccgccgcgcaccagactaacatcagcggtaacgagattaactccagttgcagagcgataagacctaaaatcgaacccaacaccgtaccgccaatacgctcaaaggcgcgagggacaacgttaccccagaacgagattggccccataatcaccaccatggtgaccagcggccaggtgctttccgggatagtaaacaggcggataatgagaaaagtgagcaggaatgccagcgcgacccgagtaccatgcacaatgcggtaatggcggtatacccggatttcaaacgggcttaatgacttatcggcacgcacgcagaaactccgtaatgagattaaaagcgctcataactcatctgtcggccagaaggcgcgcctctgaattatccgacggacaaaccgggaacagtgtaatttcccggcaggagcgaaaaaattgaaaggcgcatcttactcttttcgctttcaaaaaaaagagtggtcatcgcgttaacacaccgccctgagatgaattagtgatgttttggctgcaccgcaacatacatttcgatatcccagtacccatcttccgcgccattgttcaaataaacctcgaagcagggctttggtaacatttcataagcactgtcctgcaagagactattaaagaactgataccagggtttagcaaaatcatcaccgactacacgagctaccgccaccgcatactgaccacctgtaatttctgtcagaatgacgccctcactgttttcgggaagcgtaaagtaacccggcaccgtcacgacggtgtcgcagcgtaatttttcggcgggtgtttcatctggattgtcgtaatagacagcaacccactccttcggcacaatatttttgctatctacccacatcatcaactgctcaaagcctttctttaccgtctgttcccacgggccaacgagatggaaacctgcaacggtacgtttctcttcctgcttaatctcgtagttcatgacgcctccattgatactgtttttatatacagtatagttgcaaaattaaaaccacaaggaatgagtgttgattatgcgagcagactcgcactcctgccagtctgctgcaaaagaaaggtcaggccttatggtggaaataatcactcaggcgagaaaacatgctgccttccccgacagattccagggtaaccagcggccagtgcgccacctgtttatcacggtcgtaaagttcaatttcccctacccgctgatgggcgctaattggcgcggtgagttctttaccatcaagggtatatttggctttgatatgtggaatttcggctttcggtagcaccatccagaactcttgttccgttcccaggtcgatattttctttatcgccataccagatgcgttccgttccgacctttttcccacggtgcaaaatttgcaccgtagtaaagttttgttgcccccaacgcagtaattttcttgcctcttcctcacgaccttttgcactgtcagcccccattaccactgcaatgagacgacgctgcccatctacagccgaagcaatgagattaaacccggcaccagaagtatgacccgttttcaggccgtcaacattcatggttttatcccacaacaacccgttacggttttgctgggtgataccgttccaggtgagacttttctcactgtacatatgataaaactcgggctcgccgtggatgatagcacgagaaagcacagctaaatcataagccgagctatgctggccaggtgcatccagaccatgcactgtttcaaaatgcgtatccttgagatgcagcttctcggcatagttgttcatcatttcaacaaactgccgttgcccaccggcaatatagtcagccagagcaacacaagcgtcatttccggaatccacaattaaaccacggcttaaatcacgtaccgatacgcgatcgccctctttcaaaaacatcagtgaagaaccgacaaacaccggattatctttcgcccacgcatcgcgccccacggtgacaatatcgtctggcgtaatgcgatgactatcgatagcgcgatccacgacataacccgtcatcagctttgtcaggctggcgggattgcgctgttgatgctcattacccgcggtgaggatctgaccggtggtgtaatccatcaatacccaggacccggcatgaatctctggaggctgaggtgaaaaaggaatgttttccgccgcaaaaccagacgataagttaaaaacgaacaaagaagcagcaataataagacggcgtttcaacagcaaaccctcaggagtttcaaatagctgttctttttacggaaatacttatgaactggctggaataaagtgcaagaaaatgtgactaccctctcatttttatctgacatgatctgttgccactcgctgccaaattgtggcgctaaagctgattagcacggtgatatttgatactctggcagacagcagaaataacggatttaacctaatgatgaatgacggtaagcaacaatctacctttttgtttcacgattacgaaacctttggcacgcaccccgcgttagatcgccctgcacagttcgcagccattcgcaccgatagcgaattcaatgtcatcggcgaacccgaagtcttttactgcaagcccgctgatgactatttaccccagccaggagccgtattaattaccggtattaccccgcaggaagcacgggcgaaaggagaaaacgaagccgcgtttgccgcccgtattcactcgctttttaccgtaccgaagacctgtattctgggctacaacaatgtgcgtttcgacgacgaagtcacacgcaacattttttatcgtaatttctacgatccttacgcctggagctggcagcatgataactcgcgctgggatttactggatgttatgcgtgcctgttatgccctgcgcccggaaggaataaactggcctgaaaatgatgacggtctaccgagctttcgccttgagcatttaaccaaagcgaatggtattgaacatagcaacgcccacgatgcgatggctgatgtgtacgccactattgcgatggcaaagctggtaaaaacgcgtcagccacgcctgtttgattatctctttacccatcgtaataaacacaaactgatggcgttgattgatgttccgcagatgaaacccctggtgcacgtttccggaatgtttggagcatggcgcggcaataccagctgggtggcaccgctggcgtggcatcctgaaaatcgcaatgccgtaattatggtggatttggcaggagacatttcgccattactggaactggatagcgacacattgcgcgagcgtttatataccgcaaaaaccgatcttggcgataacgccgccgttccggttaagctggtgcatatcaataaatgtccggtgctggcccaggcgaatacgctacgcccggaagatgccgaccgactgggaattaatcgtcagcattgcctcgataacctgaaaattctgcgtgaaaatccgcaagtgcgcgaaaaagtggtggcgatattcgcggaagccgaaccgtttacgccttcagataacgtggatgcacagctttataacggctttttcagtgacgcagatcgtgcagcaatgaaaattgtgctggaaaccgagccgcgtaatttaccggcactggatatcacttttgttgataaacggattgaaaagctgttgttcaattatcgggcacgcaacttcccggggacgctggattatgccgagcagcaacgctggctggagcaccgtcgccaggtcttcacgccagagtttttgcagggttatgctgatgaattgcagatgctggtacaacaatatgccgatgacaaagagaaagtggcgctgttaaaagcactttggcagtacgcggaagagattgtctaatttgaagcctccgccgctggtacggcggaggacaatgttgagtcaggctttttgaacggtgatgctccacgctgcatcgccaatctgctgataatcggtgatggcatgtccttcttctgccgcccactgtgggattgcttcagttgcctgggtgcaatcaaactcaatcactaactcatcgccgctgaccatttctgccagagctgcttttgcttctatgagtggaaacggacagacctgcgtcaccacatccagctttttaatcaccatctttacaccttacttaatttgccgcagcagttgccagtcgcgccttacgctgcggtcgaacatacacaagccaggacgcagtccagactccgagaatcataaatacaaggccaatccagccctgccaggtcatcattgcagtcataaccagtccattaccgatagagcaaccacctgcaatactggcaccgaagcccatcagtacaccacctaacccgctacgtaatgttgtttgtgcatcagctgcgcgaacgcggaactcacggctcgctttggctgcaataaatgaccccacgaagatccctaacaccaggaaaacgccccagttaatgtatttcatgtcacccgcgaccagaaattgcagaatattggccgttggggaagtgattcctaacccaaacatgcgtccggttgcttcactcaggggccaggctaaaagcgcaatcaaaccgatgagtacagctgtgacaaagggatgccagcgtttttcaaacagaatatgagcgatcccggttcggcgcggcggtaaggtcgcgactttgagttttggcttcttcaactctttcatcaccacccagagcgttatcaccagcaaaacggcaaccaacggccacacagacaaattaaaagtctcagcaatagagttatgttcagtactgtagtgctgcaaggtttgatttaaaccactggcatgtggagaacgcatcaccgcactcatcaccatataagtgaaaagcgcgatccaactgccgatcaatccctcacccgcgcgataccaggtcccggtggcacatccacccgccagaacaattcccagcccgaagatatacccacctataacagtaccaagccacgggaacgccccggcttcgtaagtcagtaggcccgcctgaattaacgcaaaaacccccacgctttgtaccgaaattgcaatcagcaaggcgtaaaacatgcgattatttttcacgatatacatatcgcgaaaaccacctgtcaggcaaaaacgcccacgctgcatgacaaatcccagcagagcaccacaaattagcccgcttaatatcattgaaaacataaattaattaaccagatgaatgttaatgaggaaattattcatgactggtggaatgcagaccaataaccaaattctctaaattagaacaaatggttattaatgaggagttcgatacaaaagaataaaaaaaccggagccaaatgttcattcgactccggtttattattagaaaagatgattatgctacgtcttcgtactgcggaaccggattacggaagctcttggtgacgcaagccaggtaaatcagaccgatagcagcccagatcagacccagaaccattgagctttcttccaggttaacccacagcgcaccaacggtcagcgcaccacacatcggcaggaacagatactggaagtgatctttcagcgtcttgttacgcttctcacggatccagaactgcgagatgaccgacaggttaacgaaagtgaacgccaccagcgcaccaaagttaatcagcgccgttgccattaccaggtcgaagttgattgccagcagggcaatcgcgccaaccaggatgatgttcatcgccggagtacgccatttcgggtgtacataaccgaagaagcttttcgggaatacgccgtcacgacccattacgtacatcagacgcgctacgcctgcatgcgccgccataccggacgccagtacggtaatggtggagaagatcagcgcgccaacctggaacgctttacccgcaacgtacagcatgatttcaggctgtgacgcatccggatctttaaagcgagagatatccgggaagtacagctgcaggaagtaagttgcaaagatgaagatcatgccgccgatcagcgcggtcaggaaaatcgcacgcgggatcacgcgctctgcatctttggtttcttccgacaggttgctgatgccgtcaaagccggtaaaggagaagcacaggattgtcgccccggtaatcatcgggataacatgcgcatcgccagaccagaatggacgagtgctcgccagcgtaccagcgccttcaccttcaaatacgccataaacaaccatgcccagaatcaccgcgatcagcactacctgcaacacgacgattacagtgttgaagttcgctacggatttcagactacgcaggttaaaggcggtcataaaggccaccagcgccaccacaaacatccacgatgggatggaaggcaccagagcttcaaaatagattttcgccagtagaatgttgatcatcggcgcgaacagatagtcgagcagagaagaccaacccaccataaagccgacagtcgggctaatggatttctgggcgtaagtgtatgcagagccagcagaaggatagcggcgaaccagcttcccgtagctcagagccgtaaacaggatcgcaatcaatgcgaacgcataggctgtcggcacatgaccatccgtgaggcctgaaacgataccaaaagtatcaaacagcgtcatcggctgcatataggcaagacccatcattacaaccggaactaacgtaagcgttttacgcaattccacgcgagaggtgtttggagtaacgttatgcgacatggtcattctcctttacggtgataaccgtcgcgtaagcaaaaaattgccccatttttttggattcctcagcgacaacaactgtcgatttttagtaaatatctatccggtacgaagcccggcctcttggtatgaatgattggtttgaagcaaaaaataaccgacgctgatgaaacgtcggtttttagtcattttttgacagcggcgcattgtgcctaaatgggggggaaatgacaagagaatgagaggcttgtcagaataatttttctttaaatggctgattttccgtcatcagattttgcataaacaccggcgatcgcactatttgctaaaatttcatcccgccaccagccactggcaagtcctgcggtctgttcgttccagccaatccagacgggttcaaagagagtttgggcgaccactttcttctcgattaacgcgccactatcgagaaaacgttgcgccagataacggggtaaatagccgcagccgaggccgctaatttgcagctccagtttggttttaaaatcgaaaacggtaatggcttcttgttcgtcgagaagttgtgatgccgtagaagcgcctgcctgcgcagtatcccccaccacaatcgcccgatatcgcttaataatacgacgatttaacggctcttcttccagggctaacggatgatgaggcgcgaccgcaaagacttgttccagatcgcccaaccgtgaaaaaccaaactcactggaagatggtggctcatgcatcgcgccaacaataatatccgctcgcccctgagtcagggcatcccatgaaccaccgagtacgccattgataaacttcaggcgcgtcacgctatgatgttgataaaaagcttcaatgagtggcgcaagcagagaaaaaggaaacgtgtcgtccacgccaatcaccagctcgttttcccagccttcatgcagtttgatcgcctgcttttccagttcccgcacggtatgcagaacttcccgccctttctctaataacatttttccggtgcgggtgaatttagcgcggtgtccgctacgatcaagcaattgaatattaaggtcgctttccagcttgtgaacggtgtaactcagagcggacggcgtcttgtagagtttggccgacgccgccgcaaaactgccttctttttctaaggcatcgaggatcatcaacacatccagcagtggtttcatacacgcccccttgcagtgcatgcggcgtcctgctggcgtgatcgtttactccagcggcattaccagcggatcgggatactggtattcaaatcccagttcattacaaatccgactgccatcaataatcttacctttgccgctgtccagactatttctgaactgcggaggttccagccccagtaaacgggccatctgcggatagaaaacattacgcgcagggtgagctggcgcacatatattatagatgtgtccgcctttaggtgcctgtaacaacagagtgatagcgccaataacatcttctaaatggactaaattaacaccatgttcaccatcaggcgcggtttttccggcaaagaagcgtccgggatgacgtcccggtccgaccaggcccgcaagacgcagaatatcgaccgaagtaccgggtaaattgtgcagccagtcttcgagttcttctaatactcgtccactgttggttactggattacgcggggtggtttctttcaccgtgccttgcgcgtcgccatagacagatgttgagctggtaaaaataatgcggggaatacgatgggccagcgcgctatccactaactcttgtaccgcttgtaaatagaactcatcgccggggccgctacgacgtgccggaagcgtaatgaccagcgcatcggcatccatcagggcatccagatcgtcagaatcgcaaactagctcaggctccatgcgaagcagatagctatcaatgccactcattcgggccgcttcgacaccatcttgtgtggttttactcccggtgacttgccagcctcgcgctgaaagtgacatcgccagcggcatgcctaaccaccctaacccgacaattgcgacctttttcatccgttatctcctgatacaccttagatctataaggctacgctagcgtatcaaaactgacaattcattctatgaatgaatctgttcaataatgataacgacatgctgcaatgagcagtgaatcgtcggtaaccgcgtataccagacggtgctcctctgtaatgcgtcgggaccagaaacctgacaaattatgtttcaggggttctggcttccccttaccttcaaatggcgttctgcgggtatctttgataagttcattgatctttttaacaattcgcttatctgtttcctgccagtacagataatcgtcccatgattcctcagaccagattagtttcactcaatgatgtccttttccgttcctttgcctgatttcaggctatcgattgagtccatcaatctccgggcgttagcgggggagcgcagtagataagccgtctcttccagcgagttgtattcttcgagtgacatcagaacacaagcctctccattctgacgagtaataaggatcggggcatgatcttcaacggctttcatcattgttgccgacaaattctgacgcgcttcgctgtagctaattgtacgcatgtcaatctcctcttttgtacagttcattgtacaatgatgagcgttaattaactatttattaattagtttgtagatcaaggtattgtcagtgagacgaaaatccaggcttcgctatttttggtgccatcagctaagaggacagtcctcttagccccctcctttccccgctcattcattaaacaaatccattgccataaaatatataaaaaagcccttgctttctaacgtgaaagtggtttaggttaaaagacatcagttgaataaacattcacagagacttttatgacacgcgttcaatttaaacaccaccatcatcaccatcatcctgactagtctttcaggcgatgtgtgctggaagacattcagatcttccagtggtgcatgaacgcatgagaaagcccccggaagatcaccttccgggggcttttttattgcgcggttgataacggttcagacaggtttaaagaggaataacaaaatgacagacaacactcgtttacgcatagctatgcagaaatccggccgtttaagtgatgactcacgcgaattgctggcgcgctgtggcattaaaattaatcttcacacccagcgcctgatcgcgatggcagaaaacatgccgattgatattctgcgcgtgcgtgacgacgacattcccggtctggtaatggatggcgtggtagaccttgggattatcggcgaaaacgtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatcgccctgctgccaggtgccgaacgcccaactattctgccgctggcgggtgaccaacagcgcgtagcgatgcacatggtcagcagcgaaaccctgttctgggaaaccatggaaaaactgaaagcgctgggtgccagttcaattctggtcctgccgattgagaagatgatggagtgatcgccatgagctttaacacaatcattgactggaatagctgtactgcggagcaacaacgccagctgttaatgcgcccggcgatttccgcctctgaaagcattacccgcactgttaacgatattctcgataacgtgaaagcacgcggcgatgaggccctgcgggaatacagcgcgaagtttgataaaaccacggttaccgcgctgaaggtgtctgcagaggagatcgccgccgccagcgaacgcctgagcgacgagctaaaacaggcgatggcggtggcagtaaagaatattgaaaccttccacactgcgcaaaaactgccgccggtagatgtagaaacgcagccaggcgtgcgttgccagcaggtcacgcgtccggtagcttcagttgggttgtatattcctggcggctccgccccgctcttctcaacggtattaatgctggcgactccggcgagtattgcgggctgtaaaaaagtggtgctgtgctcaccgccgccgattgccgatgagatcctttatgcggcgcagctgtgcggtgtgcaggacgtgtttaacgtcggcggcgcacaggccattgccgcactggcgtttggtacggaatctgtgccaaaagtggacaaaatcttcgggccgggtaacgcctttgtcaccgaagcgaaacgtcaggtgagccagcgtctggacggtgcggcgatcgatatgcccgcaggcccgtcggaagtgctggtgattgctgacagcggcgctacgccggatttcgtggcttctgatttgctctctcaggctgaacacggcccggactcacaggtgattttactgacgcccgctgctgatatggcgcgtcgcgttgccgaggccgtcgaacgccaactggcagaactgccgcgtgccgaaaccgcccgccaggcactgaacgccagccgcctgatcgtgactaaagatttagcgcagtgcgtggagatctccaaccagtacggcccggagcacctgatcattcagacccgcaacgcccgtgaactggtcgatagcatcaccagcgccggttcggtatttcttggtgactggtcaccggaatcggcaggtgattacgcctccggcaccaaccacgttctaccgacttacggttacaccgccacctgttccagcctcgggctggcagatttccagaagcgcatgaccgtacaggaactgtcgaaagaggggttctccgcgctggcttcaaccatagaaacactggccgccgccgagcgcctgaccgcccacaaaaatgccgttactttgcgtgttaacgcccttaaggagcaagcatgagcaccgtgactattaccgatttagcgcgtgaaaacgtccgcaacctgacgccgtatcagtcggcgcgtcgtctgggcggtaacggcgatgtctggctgaacgccaacgaataccccactgccgtggagtttcagcttactcagcaaacgctcaaccgctacccggaatgccagccgaaagcggtgattgaaaattacgcgcaatatgcaggcgtaaaaccggagcaggtgctggtcagccgtggcgcggacgaaggtattgaactgctgattcgcgctttttgcgaaccgggtaaagacgccatcctctactgcccgccaacgtacggcatgtacagcgtcagcgccgaaacgattggcgtcgagtgccgcacagtgccgacgctggacaactggcaactggacttacagggcatttccgacaagctggacggcgtaaaagtggtttatgtttgcagccccaataacccgaccgggcaactgatcaatccgcaggattttcgcaccctgctggagttaacccgcggtaaggcgattgtggttgccgatgaagcctatatcgagttttgcccgcaggcatcgctggctggctggctggcggaatatccgcacctggctattttacgcacactgtcgaaagcttttgctctggcggggcttcgttgcggatttacgctggcaaacgaagaagtcatcaacctgctgatgaaagtgatcgccccctacccgctctcgacgccggttgccgacattgcggcccaggcgttaagcccacagggaatcgtcgccatgcgcgaacgggtagcgcaaattattgcagaacgcgaatacctgattgccgcactgaaagagatcccctgcgtagagcaggttttcgactctgaaaccaactacattctggcgcgctttaaagcctccagtgcggtgtttaaatctttgtgggatcagggcattatcttacgtgatcagaataaacaaccctctttaagcggctgcctgcgaattaccgtcggaacccgtgaagaaagccagcgcgtcattgacgccttacgtgcggagcaagtttgatgagtcagaagtatctttttatcgatcgcgatggaaccctgattagcgaaccgccgagtgattttcaggtggaccgttttgataaactcgcctttgaaccgggcgtgatcccggaactgctgaagctgcaaaaagcgggctacaagctggtgatgatcactaatcaggatggtcttggaacacaaagtttcccacaggcggatttcgatggcccgcacaacctgatgatgcagatcttcacctcgcaaggcgtacagtttgatgaagtgctgatttgtccgcacctgcccgccgatgagtgcgactgccgtaagccgaaagtaaaactggtggaacgttatctggctgagcaagcgatggatcgcgctaacagttatgtgattggcgatcgcgcgaccgacattcaactggcggaaaacatgggcattactggtttacgctacgaccgcgaaaccctgaactggccaatgattggcgagcaactcaccagacgtgaccgttacgctcacgtagtgcgtaataccaaagagacgcagattgacgttcaggtgtggctggatcgtgaaggtggcagcaagattaacaccggcgttggcttctttgatcatatgctggatcagatcgctacccacggcggtttccgcatggaaatcaacgtcaaaggcgacctctatatcgacgatcaccacaccgtcgaagataccggcctggcgctgggcgaagcgctaaaaatcgccctcggagacaaacgcggtatttgccgctttggttttgtgctaccgatggacgaatgccttgcccgctgcgcgctggatatctctggtcgcccgcacctggaatataaagccgagtttacctaccagcgcgtgggcgatctcagcaccgaaatgatcgagcacttcttccgttcgctctcatacaccatgggcgtgacgctacacctgaaaaccaaaggtaaaaacgatcatcaccgtgtagagagtctgttcaaagcctttggtcgcaccctgcgccaggccatccgcgtggaaggcgataccctgccctcgtcgaaaggagtgctgtaatgaacgtggtgatccttgataccggctgcgccaacctgaactcggtgaagtctgccattgcgcgtcacggttatgaacccaaagtcagccgtgacccggacgtcgtgttgctggccgataaactgtttttacccggcgttggcactgcgcaagcggcgatggatcaggtacgtgagcgcgagctgtttgatctcatcaaagcctgtacccaaccggtgctgggcatctgcttagggatgcaactgctggggcggcgcagcgaagagagcaacggcgtcgacttgctgggcatcatcgacgaagacgtgccgaaaatgaccgactttggtctgccactgccacatatgggctggaaccgcgtttacccgcaggcaggcaaccgcctgtttcaggggattgaagacggcgcgtacttttactttgttcacagctacgcaatgccggtcaatccgtggaccatcgcccagtgtaattacggcgaaccgttcaccgcggcggtacaaaaagataacttctacggcgtgcagttccacccggagcgttctggtgccgctggtgctaagttgctgaaaaacttcctggagatgtgatgattattccggcattagatttaatcgacggcactgtggtgcgtctccatcagggcgattacggcaaacagcgcgattacggtaacgacccgctgccgcgattgcaggattacgccgcgcagggtgccgaagtgctgcacctggtggatctgaccggggcaaaagatccggctaaacgtcaaatcccgctgattaaaaccctggtcgcgggcgttaacgttccggtgcaggttggcggcggcgtgcgtagcgaagaagatgtggcggcgttactggaagcgggcgttgcgcgcgtagtggtcggctccaccgcggtgaaatcacaagatatggtgaaaggctggtttgaacgcttcggtgccgatgccttagtgctggcgctggatgtccgtattgacgagcaaggcaacaagcaggtggcagtcagcggctggcaagagaactcgggcgtttcactggaacaactggtggaaacctatctgcccgtcggcctgaaacatgtgctgtgtaccgatatctcgcgcgacggcacgctggcaggctctaacgtctctttatatgaagaagtgtgcgccagatatccgcaggtggcatttcagtcctccggcggtattggcgacattgatgatgtggcggccctgcgtggcactggtgtgcgcggcgtaatagttggtcgggcattactggaaggtaaattcaccgtgaaggaggccatcgcatgctggcaaaacgcataatcccatgtctcgacgttcgtgatggtcaggtggtgaaaggcgtacagtttcgcaaccatgaaatcattggcgatatcgtgccgctggcaaaacgctacgctgaagaaggcgctgacgaactggtgttctacgatatcaccgcttccagcgatggccgtgtggtagataaaagctgggtatctcgcgtggcggaagtgatcgacattccgttttgtgtggcgggtgggattaagtctctggaagatgccgcgaaaattctttcctttggcgcggataaaatttccatcaactctcctgcgctggcagacccaacattaattactcgcctggccgatcgctttggcgtgcagtgtattgtggtcggtattgatacctggtacgacgccgaaaccggtaaatatcatgtgaatcaatataccggcgatgaaagccgcacccgcgtcactcaatgggaaacgctcgactgggtacaggaagtgcaaaaacgcggtgccggagaaatcgtcctcaatatgatgaatcaggacggcgtgcgtaacggttacgacctcgaacaactgaaaaaagtgcgtgaagtttgccacgtcccgctgattgcctccggtggcgcgggcaccatggaacacttcctcgaagccttccgcgatgccgacgttgacggcgcgctggcagcttccgtattccacaaacaaataatcaatattggtgaattaaaagcgtacctggcaacacagggcgtggagatcaggatatgttaacagaacaacaacgtcgcgaactggactgggaaaaaaccgacggacttatgccggtgattgtgcaacacgcggtatccggcgaagtgctaatgctgggctatatgaacccggaagccttagacaaaaccctcgaaagcggcaaagtcaccttcttctcgcgcactaaacagcgactgtggaccaaaggcgaaacgtcgggcaatttcctcaacgtagtgagtattgccccggactgcgacaacgacacgttactggtgctggcgaatcccatcggcccgacctgccacaaaggcaccagcagttgcttcggcgacaccgctcaccagtggctgttcctgtatcaactggaacaactgctcgccgagcgcaaatctgccgatccggaaacctcctacaccgccaaactgtatgccagcggcaccaaacgcattgcgcagaaagtgggtgaagaaggcgtggaaaccgcgctggcagcaacggtacatgaccgctttgagctgaccaacgaggcgtctgatttgatgtatcacctgctggtgttgttgcaggatcaggggctggatttaacgacggtaattgagaacctgcgtaaacggcatcagtgagttgcggggtaagcggatgcgatattgttgccgcatccggcaaaaaaacgggcaaggtgtcaccaccctgccctttttctttaaaaccgaaaagattacttcgcgttgtaattgcgtagagcattacgccccagcacaatccccgcgccaaccatgccacccagcagcaccgccagaatcaaggtaattgcctttttcgggctatcacgacgaataggtaacatcggtttcatcacataacggtaagcatgaatatcaagatcatcaacttttaagctttcgatatccagcaggttttgacgagtctgatagtagtttggcgagaacaccaacggacgggtcgcctcatgcttaatcatcgactccagcgcttcgctccccaaaaggaacaacgtatcttgtgtgatatcttcgccagtctgttgaatctgcggttttgtcacctgcgcctgattcgcatactgcaacgcttcctgaatctgacggatacgcagatctttctgctcctgcgcgactacttcctgcgttcttaaagagtcctgcaagtttttccgtcccagagcaatgttgtctttgagatccttttctagctcttgattcactttatcgtcaacttgctgaatgtattgggccaacttcatttgtgcgccctctgcagtttgcccaacataagaaacagtcaatggtaattgctggttcttaacagaaggttcgatggtaagtttttctcgttcttcctgattatccagcgtttctgctaatgcagagaaggcagaactgaagcgaccaattaacgtctcctgcaaatccgatactttcggtgcagcctgaccatagataacattcatggcattgttatagccagcaatttgccccacgtcgggctgagtgataattgctgttgacgtccatttctccttcgctactgccaaatatccaatagccagggcaatagccacaatgacggaaatgatgattgtcatcttgccacgccacaactgcactagtaaatcaatcaaatcaatctgttccgggtcatggttttgcccagaaacattattattttctactctcatcattaccctaactgacggaaatttccaagtccgcatagtttagcgataatcctcgtgaatgctataggataagtgataaaaataatgaattgttgtgtaagtaacaaaagacaatcagggcgtaaatagccctgataacaagatgttagtcgctgccaaagagatcgcgggtgtataccttatctgccacatccttaagctcttctgccattcggttagagataatgacgtcggcttgttgtttgaaggtggcgagatcacgttccaggcgagagttgaagaatgagtcttctttcatcactggctcgtagatgatcacttcaacacctttcgccttgatacgtttcataatcccctgaatagaagacgcacggaagttatctgaaccgctcttcataatcagacgataaatacccaccacttgcggcttgcgtgacaaaatggcatcggcaataaaatctttacgcgtgcggttagcatcgacaattgccgagatcaggttattcggcacagactggtagttcgccagtaactgcttggtatctttcggcagacaataaccaccataaccaaacgacggattgttgtaatggttgccaatacgtgggtcgagacaaacgccttcgattatttgacgggaattcagacctaaactttctgcatagctatccagttcgttaaagtacgccacgcgcatcgccaggtaggtgtttgcaaaaagtttaatcgcttctgcttcagtggagtcggtaaacagcatcgggatattttgcttaatcgcgccttcctgtaacagagcagcgaaacgttctgcgcgttctgaacgctcaccgatgacaatacgtgaaggatggagattatcgtaaagggctttaccctcacggagaaattccggggagaatataatattttcagtgcgatatttcttatgcatcgctgcggtaaaaccaacgggaaccgttgatttgatgaccataaccgcataaggatttatctcaactacgtctttaattactgattctacactggatgtattgaaataattagttttaggatcatagtcggttggagtggcgatgatgacataatcagcatcccggtaggcttcatttttatctaatgtggcattaaagtgtattttatctgattgcaaaaactgctgaatttccttatcaacaataggagatatccgatcattcagcatagcaacgcgtgacggtaaaatatctaatgccacaacctcatgattttgtgcgattagaagcccgtttgacaagcctacatagccagtaccggaaatggtgattttcatttcatgctctcagaattaacttaactgtgaatcatgatgtttttagcatcctgataagagctaaaagttttaacgctacgttgttcgatggtcaacgcaacgaaaaacaattcagattttctttataagaatagctgatatttattaagttaatattaagcagtgaaatttagtctataagatatttggcaaaaaaaagcccggtgcaatatacgccgggcctcaattttattgttggttaaatcagattaatccagccattcggtatggaacacaccttctttatcaatacgcttataagtatgcgcaccaaaatagtcacgctgtgcctggatcaggttcgcaggcagaacagcagcacggtagctgtcgtaataggcaaccgctgcggagaaggtcggaaccggaataccgttctgtactgcataagcaacgacatcacgcagcgcctgctggtagtcatcggcaatttgcttgaagtacggagccagcaacaggttagcgatctgtggattttcggcataagcatcggtgattttctgcaggaactgcgcacggatgatgcagccagcacggaaaatcttcgcgatttcgccgtagttcagatcccagttgtactcttcagacgcagcacgcagctgagagaagccctgggcgtaagaaacgattttgcccagatacagcgcacgacgaactttttcgatgaactcagccttgtcgcctgctggctgtgcttgcggaccagagagaactttagatgcggcaacacgctgatctttcagagaagagatataacgtgcaaacacagactcggtaatcagcgacagcggttcgccgagatccagcgcgctctggctggtccatttaccggtacctttgttagccgcttcatccaggatcacatcaaccaggtagttaccgtcttcatcttttttggtgaagatatctttggtgatgtcgatcaggtaactgctcagttcaccgttattccactcggtaaaggtctgcgccagttcttcgttggtgaggttcaggccacctttaagcagagaataggcttcagcaatcagctgcatatcgccgtattcaataccgttgtgaaccatcttcacatagtgacctgcgccatcggcaccaatataggtaacgcatggttcaccgtcttcagctacggcggcgattttggtcaggatcggtgctaccaattcataggcttctttctggccaccaggcataatagaaggacctttcagcgccccctcttcaccgccagaaacaccggtaccgatgaagttaaagccctctgctgaaagctcacgattacgacgaatagtgtcctggaagaaggtgttaccaccatcaatgatgatgtctcctttatcgagatatggtttgagggaatcaatagcagcatccgtgcctgcacctgctttcaccattaacaggatgcgacgaggcgtttccagagattcgacaaactctttcaccgtatagtaaggaaccagtttcttgcctggattttcggcaatcacttcttccgtcttctcacgggaacggttgaaaatagagacggtataaccacggctttcgatgttgagcgcaaggttgcgtcccatcactgccataccgactacgccgatctgttgcttggacattacatactcctgtcaggtgtgatcaccgcgctgaatgctcgcggcctggaatgttcgcaaataagtatacaaagtacttattaaagtataaatagcttatccatgcttatatgcttacggctttatattacgggtgaaaaactgatgaaattcgatcaaagttgcgatttgataaaatacgttttctggctaaatatctaaaagtactttttaagtgccatctgaaggcttttgaaaaaaaacttcgattgtcatgatgagcataatgtatcgcatgaaaagcgggaacataatgaagtctgacaccagccaggctaagcctcaagcacaggtcaatatcttcacagtacataaagtaaccttgatcgaagccatttacacgcacaaaatctgaaaaacgtaccagcataaatgatcctgcgcaccaatcaacaaccgtatcagaatagatactttctttaggaatttttgttttattaaggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttaatccctaacataaatgacacaataaaatcagaaagcacaggaaattttcttacggaataatcatgtaaagatttcgcttcatctcggaacaggcataatgtactaaaagcataacgcttactttcgacatatttaatatatgtcagcaaatcatcatgcttcatgatgatatcgggattcaaaaacaaaatgtaatcatcatctgcgggtctatatttttcctttacatacgccaccgcaatattattattatgaccaaagccgtatacacctccactaatatagtccaggcctgcataatgctggcatatttgtttcaataatagagagtctttgttgtcgcgtacgataatcttgtagtgctcatcgtcagcattaagattttcgagtaattttttgatgtagtcttcatgtccgtgggaaacgattattatatataccatttcaatgttcttcagtaataaaattaactagttcatcaaacccaactaatacattttcattacgataaatgaaatttgcatcagagatatcttttttgaggttaccttttttgaagtcaataataagtttaactaacatgtcatcgttattagaatcaaaaaaagctttcttttcataactaccaagagtttctctagtaaatgggaaatctgatgctaatacccacttacctcgctctttagcttcagacaacggcaatccccatgtttctaacctagagggaaaacaaactatatctgaaatattataacaatgatcgattttttctttatccaagtacccgaggaaatgaacattatccagtccttctgcaagactgataatatattttgcatacgcattttctgtaccactgatagtaagcagaaatttaatattggattgttctttcaatttccttgctgcactaataataagctcgtaatttttaaatactcgtggaacagcagggtaaaatattgtcaactcagaagggttattcttaaattgagaatcatcatcagtaagttggcttttatcagataatttaatttctggccgactgacaatgatgttatttatagaatatttcttgataaatttttctttcatccagaattgttgaacaaacactgcagtattttttttaatgtttattttatatatcagcccgtatagcattttaaataagaaaaagctaggctccataagaatttcacggaataaaattcctttataaaaaggtgcagggttatgacaatacacatatctttttttagtgacgacattggccgtaatatcatgcagacaaatccaatgcgtagcattcagctcttttgaaagttttttacaaactacatattcaaagtgcaaacgttttagccacgaccctttaacctcaggaaactcaatgaatttaacccatggataactttcttttaactctttagcagaatggactaatgcgataaaactgacattttctttattattagttgctgccaaaaattttttcaaaatggtaaatggaccgccagtggtaaaattgaccgcagaaacaacgactatgctttttcccataatttggtctcatgattgtatttctttatgatttttgctggtactcccgcaatgacagtattttcgggaatagaacctctaacaacagaattggcgccgactacgactccattaccaataattgttccaggcaaaaccgtcacattctcacccaaccaaaccctctggccaattacaacagctgaagattccaacgtgcgcatgtctggaggtatatttggcgaactcattggatcagagtgcttaaaggaaccgtgattatgatcggtaataaatactttacttgcaataagcgtatcccgacctatcgtaacgctctcaattgaggcgatatgaacatagtcgttaacttgcacattatcggaaaaaaaaatcacgccacgtccaaatgcatccagcctgagaccgactccacttgtgaaattttcaccaaaattaatgctaccatcattgcgaatatagcagggaaatcgaataattctacagttccggtaaaatacacgagtcaataagacatctctaacaagccgaataaaaccacagagaccatatcgtttagcgagttttaagatcatcgatcacctcttcaagaacatccctgaagtaacttcctgttcgaattttctgagaaataatttttgtattctcactaatttgcttataagtttctattgtcatggagtcaacaatctcttgcatttctttgattgatcccactgcatatcctattctattatctacaatgaaatccgcaagggcggctttatcccatataaatactggaagttccattgaaagataaagagatgtcttatgagggttattaaactttaaatagtcgccaaaggcaccactacaggtttcgacagaatctccatcccaaatgagtccaaattgcatgcctgggaggttaatcttttccggagattgagcatcaaaacttccaagatatttaggattatctttattttcatagttgacaccaaagagagtaaaatcgcatccttcagtatatatgaaagaacatttatgcctagaaaggttgccagcatatatgacccctcgttgcttatccgtaacatctcgatgctccacatcagatgagacgaggtaatcaaatatttttatgtctttgattttatcctgagacatatatttactaaggtactttgtcatttgtggattgtgacttatgaccatatcacaggtagcaagccgcacagaatcactaccccctcctcctcttaattcatcaatatcatgaatcagaggtactattctaaattttagaaggcggtgaaagaatgacaatatatgccaaaatggtttggccatcgggaaattgaaaattaaaacatctttattttcaagaccgcagagaaatgtactaagcttaacagaactaataattctctggactactccaccccatagaggaatgttaacaacagaaatgttttcataatctgaagcaatgtccagtgcatcttttcttgctttaaatccagcatcgcgtctagagaaatttaaatcattcaaaaaatacattttcactttattttctgggccttaagaaattgagagaatactatgatacaaagagttatttgtatccaactgctaatattagtcatgaagctttcatgataaaaaatgaaagaaaaggtataaataaaatatgaataaaatattttcacagatatgtaatttcgagacaatctccataaaacacctgaaatacagccatgaataaccatcatcaaatagcttagctccgcggaaatataaacataatccgaaaaagcagtataaacatttgttggcaaacccacccacacaaattctttatgcaacgacatagagactccacctgttaatagccccatcagcctttcaaaaaaccaaaagacatgagaactggcagagttagatacttgctgaaaataaaactcctgaaacgcgattatagggctgaccaaatacatggatagataatatgccatccccccaggcagtccacgtaaaaagagcatatacaaggagaatagaacacctacagctgtaataagataaacataatgttttactctattaacacctacgatgaatgcataagagatgataaccataaagacaatttgcttaccagtattcagtataattgcaaagatgaatacaataaaaacaagtaaagtaaatgttttacttacctttgtattagtaaattttttagaccaaataaataaagcaaaagtagttagaatgattggctgcatgtatgctgagaaatttcttgatgtgtcttcaacatcagcatctcttatcaaattcatatagctaagtaagctagtcccgaactggtagttacttaacctcatgcatatatatatcatcgaaaaagaaataactaacaagcctacattatgcactttcttcgatggtatgctataaatagcattattgacttttctgatatttagatctaatacactttccgtcaataaacatgacagggtaaatgtcaaaacattgcaaagtagaaaaatcaacgtagcgtcatttaactgaaaagcatatatatctgacgttatttcatatcccaataagaccagtgcgaagatgatattaacgcatacggctggataaaatatatccttcttaagatataaacagataaatgctgtaatgagaaagacactaattacaagatagatcattaatccgtactcattatatttttcacttgataaagagcggcagatatcacttgatgcatatcataatatttatactcggccaaacgcccgccaaatataaccttgtcttctctgctagctaactctctatatttcttaaaaagctccatgtttttattatcattaactggatagtagggttcgtcgccaactttccactctaatggatattcttttgtaacaaccgtatgctttgtctcaacatagtcaaaatgtttatgctcaattattctggtatatggtacattagcatcagtgaaatttattactgcattcccttggaagtttggaaattcatggcgttccgtctcaaattttaaagagcgatattctaacgctccaaacctatagtcgaagtactgatcaatgggtccagtgtagatgattctatgggctttactcgctagagaatctttgtctttcaaaaaatcaatgcctaattttacgtccacaccttcaagcattttttcaataagcttagtgtagcctcccaccggaataccttgatagcgatcggaaaaataattgttatcaaacgtaaatctcactgggattcgcttaataataaatgcaggcaattcttttgcacttcttccccactgcttctccgtataaccctttatcaatgcttggtataagtcctccccaactaatgaaatcgcctgctcctccaaattttcaggtaccttgtcaccatacttttttttctgagcattaatgatattttgagcttcttgaggatctttaactccccacatttggtggaaagtattcatattaaaaggaaggttgaataatttgtctttataaatcgccagtggagaattagtaaaacgattaaattctactaaatcattaacgtaatcccatatatatttatcattggtatgaaaaatatgtgcaccatatttatgaatctggataccctcacagtcctctgtgtacgcatttccaccgatatgatttcttttctcaatcactaaaacttttttgtttagcttttttaactcattcgcacaaacggcaccaaacaaaccagaaccaacaatgatataatcgtacataaaatcctcagcaaaccagtaatttattatttcttacgaacatcagcatgagtgacgtaactaagcactctgttgcaagcaatgttattgctgcaccaatctctttaaaaagagttgttagcggaaaaatcaacaacaaactcaacaaacccgcagcgattaaaatcttactgaattctttcttataattatgggtcagcataacttgaatgccatagacattacttaatgaaataagaaaaggcagaggcgatataatcattagcacaatcactgcattatcatatcccggccctatacttatttttactagtatagatgcacccaagagcagaattaatgaaaaagcaccaccaatcaaactcaagcaggtcaatgattttttaattaaaatcacacccttcacacgattaagaacaagcgtacttgatattcttgggtatattgcttgggtgataggatttaatagcccttgaagcgcgtttcttatagtattggccgcattaaaattccctacggacgttggtccagatataaatcccaggataataactattcccgtagaatataaactaatagcagatgtggaaataaaaacatgaaaaccgtctgctaaagatcgacgcacattatgtaatgatagcgtaactttaccaatccaaccttcatgaacaacgatagctagtgcaataattccagcaaccagatttgcacttgactgaataaaaccggcaattgctatatctgactttgtgttcacaaaaataaatgttagagggataatagccaagcgggataaaatactacttaaagtcagccatttcattttttcttttccctgaaacagccagatagggtagattaaattcccgactaatgcaggaacaaacgaccatataattacggcatgcttgttatattcaggaacaagcaaggtcatcgacgttaagaaaatcaatgtaatgacgataagaactatttttgaaaatatcaccgcccaaaaaatagacgttactttatctttactatctgctgctttggcaatactctgagttgctgtgagattgaaaccatattcaacaaacattatcatatatagcatagtcgcttggcaaaaaccgaatataccgaaattttcaggaccaagtgttcttacaagatatggaaatgtaagcaatggtaaaagataattgctaccttgaacgacagccagatatataacgtttcttcttaaagataatttattcgtattcatgcaattaattttaatctgataagctcatctaacgtaaagagcctttcatcttttggcgaaaggattaaccctgatgtttggggccaatcaattgcaatgcgttcatcattccaacatattccacaatcgctttcaggatgataatagtttgtagttttatattgaaattcagcgatatcagacagaaccaaaaagccatgagcaaacccttttggtatccacaactgctgcttattatcagctgaaagcagaacaccaacccatttaccaaaggataccgaattgggtcgaatatcaacagcaacatcaaaaactgctccatgagtgcagcgtacaagtttatcttgtgcgtactcgccgcgttgaaagtgaaggcctctgagtacattttttgatgaacgtgagtgattgtcttgaacaaagctgaccggatagcctagaatatgttcaaatgctgattgattaaagctctcataaaagaaacctctatcatcaccaaatactcttggctccagaattagcacatcttcaatttcagttctaatcacattcattaatttgaatccttcgtcattttataaagatactgcccataattattctttattagtggtacagctaattttcttacttgctcaacatcaataaaacctttacgaaatgcaatctcttcaggacaggaaaccttcaatccctggcgctcttcaattgtcgcaataaaattacttgcttctatcagactctgatgagtccccgtgtccagccacgcgtagccacgccccatcatcgcgacagacagacgtccctgctcaagataaatacggttaatatctgtaatttctaactcaccacgtgcagacggcttcaagtttttcgccatctgaaccacgtcgttatcataaaagtacagacctgtaacggcgtaattactctttggttctaacggtttttcttccagactgattgccgtaccgtttttatcaaactcaacgacaccatagcgttctggatcattaacgtgataggcaaataccgttgcaccactttctttgttaacagcggcctccattagcttcggcagatcgtgaccgtaaaagatattatcaccaagaaccaaagcacaatcatcaccaccaataaactcttcaccgatgataaatgcctgcgcgaggccatctgggctaggttgcactttgtactgaagattcaggccccactggctaccgtcacccagcaattgttgaaaacgaggagtatcctgaggtgtactgataatcaaaatatcgcgaatacccgccaacatcagtgtagagagcgggtaatagatcatcggtttatcataaataggtaatagctgtttactgacagccatagtcacaggataaagacgtgtaccagaaccacccgctaaaataatacctttacgcattttcatttcatcattccttttaattcatcttgctccaccatcacgaacaagatgcaaaaactattaaattgctgtagtcgtaaataattcattgagcattcgtttcacgccaacctgccagtcaggcaagacaagcgcaaagttctgctgaaatttttctgtattaaggcgagagttatgtggacgacgagctggtgtaggataggctgttgttggtactgcgttgagcttgttgagtgcaaggggaatgcctgctttgcgcgcctcttcaaaaaccagcgcagcataatcgtaccaggttgtggtaccactggctaccaaatggtacaagcctgcgacatccggtttattcagtgcgacacgaatggcatgtgctgtacaatcagccagcagttcagcacctgttggcgcaccaaactgatcgttaataaccgctaattcttcacgctcttttgccagacgtaacatcgttttggcgaagttatttccttttcctgcatagacccagctggtccggaaaataagatgcttcgcgcaatattcctgtaacgctttttctccggctaacttggtttcaccgtaaacatttagtggtgcggttgcatccgtctccagccatggcatatcgccatttccagggaagacgtaatcagtcgagtaatggataacccaggctccaacttcatttgctgctttcgcaatcgcttcgacacttgttgcgttaattaattgtgcaaactccggttctgattctgctttgtctactgcggtgtgagcggctgcattgacaataatatccggccgaatgcttcttacggtttcagctacaccttcaggattactaaaatcaccgcaataatcagtagagtgaacatcaaaagcaatcaaattacccaaaggtgccagagcacgctgtagttcccaacctacctgccctgttttgccaaaaaggaggatattcattactggcggccctcatagttctgttcaatccacgattgataggcaccacttttcacattatcaacccattttgtattggacaggtaccattccaccgttttacgaatcccgctctcaaacgtttcctgtggtttccatcccaatgcgcgaccaatcttctcagcatcaatagcatagcggcgatcgtgtcccggacgatcagcaacataagtgatttgctcacgataagatttctctttcggtacaatctcatccagcaaatcacaaatagtgagcactacatcgatgtttttcttttcgttgtgcccaccaatgttataagtttcacccgctttaccttcggttacgacggtatataacgcacgcgcatgatcttcaacatacaaccagtcgcggatctgatctcctttgccataaataggtaatgccttaccttccagtgcattaagaataaccagtggaataagcttttccgggaaatgataaggaccatagttgttcgagcaattagtcacaattgtcggtaaaccatatgtacgtttccacgcgcggactaaatgatcgctggatgctttggatgcggaataagggctgcttggcgcgtaagctgtcgtctcagtaaataagggtaattcttctgtattatttacttcatctggatgaggcaaatcaccatagacttcgtcagtagaaatatgatgaaaacggaagctatttttcttgtcgctatcaagagcagaccagtaattgcgagcggcttccaaaaggacataagtaccaacaatattggtttcaataaatgccgcagggcctgtaattgaacggtcaacatggctttcagcagccaggtgcatcactgcatccggctgatgctgagcaaaaatccgtgccattgcaggtgcatcgcaaatatccgcatgttcaaaaacatagcgttcagaatcagaaacatcagcaagtgattcccggtttccggcgtacgttaatttatcgacattaacaacactatcctgcgtattatttataatgtgacgaactacagctgaaccaataaatcctgcgccaccagtaacaagtattttcacttaatttattccatattacttcagagcatgctgtgaaataagcggctctcagtttgattaatagaggtattaatgcacgctaccgcccctggctttacagctaccagagcactgcatgcatgcctatgatgtgacgagcgttacccactcgcgctaaacccgaaaaattcaaacgctaattgtcttaccaatccgctctggaaacaaggaaaatcctggaaaactttgaataaaaccctactgctaactcgttgttattctgatggtttatataaaacaacggcaggaagattcgcaacaaattacttttgctgcgaattttcactgccgttataattttcttatcaaccgttacatccggtcagattttcattattcgcttaacagcttctcaatacctttacggaacttcgccccttctttcaggttgcgtaggccatacttcacaaacgcctgcatatagcccatttttttgccgcagtcgtaactgtcgccggtcatcagcattgcatcaacggattgttttttcgccagctcggcaatagcatcagtcagctgaatacgtccccatgcaccaggctgagtacgttccagttccggccaaatatcggcagaaagcacatagcgacctacggccatgatgtctgagtccagcgtctgcggctgatccggtttttcgataaattcaacaatgcggctgactttaccctcacggtccagcggctctttagtctggatgacggagtattcagagaggtcacccggcatacgttttgccagcacctggctgcggcccgtttcgttgaaacgtgcaatcatggcagcaaggttgtaacgtagcgggtcggcgctggcatcgtcgatcacaacgtctggcagtaccacgacaaatgggttgtcaccaatggcaggtcgcgcacacaaaatggagtggcctaaacctaaaggttcgccctgacgcacgttcataatggtcacgcccggcggacagatggactgtacttccgccagcagttgacgcttcacgcgctgctcaaggagtgattctaactcataagaggtgtcgaagtggttttcgaccgcgttcttggacgcgtgagttaccaggaggatttctttgatccctgcagccacaatctcgtcaacaatgtactgaatcattggcttgtcgacgattggtagcatctctttgggtatcgccttagtggcaggcaacatatgcatcccgagacccgctacaggaataactgcttttaaattcgtcattatttcatccacctgtaaaatggttgctgaattatagcttgttcgatttttttcgccagcatcaattaccctgaattgattactgaattacttgtgatgttacgccgcttcgttgtggattgcagtagcattgttcctaagtatgactccatttttccaggaatggtcgcaaatctactccctcagttccggcaatctaaagttaatcttctccacattaacaatatggtgattaatcctgtcgatatcgacggagctttgtcctttttcattcaccgcatgaacatttgcaagagacagcagtgtttcttttttcgccataaaaacaccacgaacgtctttgcgcatgtcaaagttcatgctcaatgcgggtccaactgaggattcctgcatcacattgatatttcgcataaaaaaatgttgcggtttgttgtgtaactccagcgacgcacgcttcatctcaatgttagttagcgccacaaaggaaacagcattcccggcggagatttgaatgccgcgcaatttataagcaagatgagtattatccagttgaatatcattcacccggaaattttgcggtatcgagagatatttgcctttaattaccccatagccgattaacatcccggcgctattaatcatttcaatattatcaatcacgaaattgtcacaaccgtaaatagcgactgtcgcgttatcaatgcccgctttcttactgaaatccggcgtgatattgcgggctttgatattacgaataacaaaatgtttaccattttcaacatgtatcaactgccgacaatccgatcccgtgatattcgccacgacaaagtttttcactgcctggtcttccgggtagttgttatcataagtgcttcccgcaaggcctatgccgatgccccagttgattttgccgttggtacagttgatgcgctcgatgacatggtcagatatcaaaatatcacggtcgttaattgccacgttccattcaatggcgtcgccttgtaagtcgctgaacttacaattggtgatgttggcaccgataatctggttatgaaatccctggcgtaagatggcgtaattagcgtggctaacggtcaggttatcgatgatcaggttgcgcatgacccgtttgtttttgccgccgatataaatctgcgtcaccgggccaaagccgctcatagtcagccctttgatggtgcagtcagaaccacgcacatccagggtgatgttatgcatactgccgccatcctcccctgtcacctggctgccgtcctgtaagacaaatcgccctctgccgttgccgcgcaagcttccaagaatgtgtaacgttttaccgggagggataaagatgccggtgttgatattgtcacaaaccaatccggcaggcacgacgactgtttgcccttcgctgaaggcttgtttaaatgaggcgatccagtcgtgtgggttgtagtcgttaatgttaacgctttgtcgggcgggaagcgcgcgggcgaaaggggtatggaggaaggcaagcgccgagcttgccgtcaggaacgtgcgtcgggagagttttttaaatggcatgcgttctcctctataaagcctgcagcaagctggcgagttctcgattgatcacctgctggttaaaatcgtgttcaactttttcgcgcgcgcgtttgacgaccggagccaattcgtcggtgtccagttggctaaacgccgccagtcgttgcgccagtgcgcgagcatcgttctcaggcaccagccagccggatttgtcagcctccaccagttccggtattccactatgcagagtagaaaccaccggaataccgaccgccatcgcttccattagcgccaccggaataccttccatatcaccatccgcacctgtaaccgatggcaacaggaagacatccgcgtcgtcgagcatcgctttcacttcatggctcggtttaaagcccggcatctccaccacatcttccagttgatattgttcgatgagggtgcgcaggcgtctttcccacgggccaatgccgaggatgcgatagcgaaatgccacgccctgctctttcaactgacggcaggcttcgatcgccacatgcaggccttttttctcggttaagcgtgcgacggaaataatctccagcggcgttgcgggcgctttcacgggacgcgggctaaagcgcgtcatatctacgcccatgcgcgatacggcgattttttccctcgggcagcccattttttgcagccttccggcccacagatcgcttatcggtaacatcaggtcgccacggcgaaacagttgctgatattcgggagtgtagtggttgagcacttcccgactggagatatcaataccgtggaagatagtggcaattttgccgcgaatgacacccagttcgcggagttttgctgcggttacccccgcgggaccaaaatgagcgatgaacacatcggcgcgaaacggtgttgcgacctggccgcaaatggcagacaaaatcaggttccgcgactcggcaccatagcgtttgaggttgagcgcctgccaggtatttttacgatgaatgccgcgcaaggtctggctggctcggtggcgcagtttcgccactttgcccgtaggttcgtcctgtaaccagcgggttctggcagcaaggttgtatttcgtccatgccgcgtgggtgttttgtgtgtcgcctttttgcagcgcgagaatctctacctcaaatcccatatcaataaacgcggtaatttggttaaggacgaaggtttctgacgacagcgggaatttcagtaaaaagaagccgaccttcatttcacctccccgatgcgctcaagcacagactgcaccatctgcattcctgtctgacgctcacgactgacggcttcactaagtcgcgcattcagcgccggaagctggcctaaggtatccgcaaccatcgcttgcaggctgccgtctaataaatgacggatatcaattgccatctccggtagtcccagctgctgcataatcccggcggatttatgttcgtagttgatggcaattgccggagtggcaaaattcatcgagataatggcagagtgcaggcgcgtaccgacggtgagttcacaggcccccagaattttgcccatttccagatcgttgagttcatccatcactacgtggtaacgggcaggatcgctgatgtgctggcgcaggttgagcgccaccatgcggtcgtctttgttatagctgtcaatgcccgtacaggtggagagcgcaatcacctgatacccttcatcgagaatgcgattgaccaccccggcaaaggctttttcatacgcttgttgagtggtgccgagacgtttgtcaaacggtgccagttcgcgcagggtaatggccaccgttttctgttgtgcggcaacgtccagccagtgttgaacggcatagctggcggtgaagtcttctgtgtggtgatcgaccagccacgcggtatcgacgccatgttccacttttgcggtggtgatattgctgcgtttcatcagatcaaagctgaccgattcgcgcaggatcagcgcgtcgcagtgaccaaaaacgtagttcgccagttggttaaattgctcatcctggaacgggccaacactgtgaccaatcataaacagcggctttttcgccataaacgtgcaaagtgcatgttcaaactgcggcacgccatagagatcgacaaaaaacgatccgccgacctggataatggcgtcgtaacctgacagcaggcgcacgaagtcggtgaatccctgggcgatggcgatattgcgcagcttgccagtgtcggtgacgcgtgagagcaatacctgatgctggtagcggcgacggaggacttttttaacgcgcccgacaacgcccgccgcgctgttgtgttgtttcatttgcaggaacagcggatcgcccattaccgggcggttgagcagccaggaagaactgaccggatagcggctcatcacatccacttcggcgtgtggattgagaatgttgatggcatcaagtaagccgcgcaggatggcgctgtcgccacgattgccgcaagtgtggttgcccagaataagtaatttcattttttcctcataaatttgatgccaggtgaggctgcgtttgttttgttcgttgccgctttttgcctgatgcgacgctgacgcgtcttatcaggcctacaagacccgagcacagaaccgtaggacggataaggcgttcacgccgcatccggcattcagtgcctgatgcgacgctgacgcgtcttatcaggcctacaggtcccgagcacagaaccgtaggacggataaggcgttttacgccgcatccggcaaccgttgtcggaaccgaaaacagcaactcaccccgcccgtaaaagcattttcattttttcgctgcgacaaaactgacgcttcacttccaccaccagcggatggcgcgacagcacaatcatcaccacaaacgccagcacccccgtggctatttgcaccgccagcagcatccccagcgccagttgccctttcagcacaatgcccagcgcataactgaccaccagcgtcggcagcgagagataaaacggcagccataaactcaggatgtactggcgataactggaaccaagaaccggtttaatcatcacgaagtaactcagaatggtgttgataatttgcaccagcaggaagccaagcgtgacgccgatcgcgcccgccatctgcccacctataacaatcgccggaataaacagaaatgttttgaatacgttgaatttaaagctgatatcgacccgcgctttcgccatcagcagcgaaccaatcgggttacctacggagcgcagcagacccaccacacacagcaattgcagcaccggaataatgctgttccacttctcaccaaagaccagcggtacaaagttattcgacaccaccattagcccgagcagcgccggaaagttgataatccccactaccgacagcagcttgtagaagttaacacgcagcttttcggtatcgtcctgaattttggcgaatgccggaaacaacacgcgggtgatgattgggttcagcttcatcggtggcacaacggccacgttgtacgccaggttgtatccccctgccacgcccgcgccgagaatacgcgccagcacgagcgttgaaaggttggtattgagatagttgatgatgctgtccgccgtcagccaggcaccaaagcgtaagttcggtgccaccgacgccagcgagaaatgcagaccggggcgataaattttgcggccaaagtagccaaacagcagcgttctcaccgcactattgaccagataaccgaggatcgcggtcatcgccagcggccagaaatgggcgctaaccaccgtacaagtgaagcccgccagcaccgcgctggtttcgatcatgccgattttgttgaactccagctctttttgcatcaacgcgcggaactgttgcccgtgggggattaccacaaacgccagcgataatgttttaatcaacggtgccaggtccgggttattcagcacgtcgccgatgagatcactcaacaaaaacaccgccacgcacaccacgatccccagcccgacgttcagccagtacaacgtggtgagttcaaggtgactgatttcttttcgctgaataatcgagttagcgataccgaagtcagaaagcgtatctgccagcgcgataatcaccagcgacacggtaagcaggccgaactggtggttgtcgataatccgcgccagcacggtcatctgcaccagcccgaggccgatgatgatcaccgtggcaatcgccgaccacttcgcgccgctgatggttttttcacgtaagctcatatcaatatgccgctttgttaacgaaacctttgaacaccgtcaggaaaacgattttgatatcgaaccagacgctccattcgcggatgtactcaaggtcgaactcgacgcgtttttccattttctccagcgtgtcggtttcgccgcgccagccgttaatctgcgcccagccggtaatgcccggtttcaccttatggcgcagcatgtagccttcaatgagctgtcgatactgttcgttatgcgctactgcgtgcggacgtggaccgacaatcgacatccccccggtcagcacattgataaactgcggcaattcatccagcgaggtacggcgcagaaagttccccactttggtgacgcgcggatcgttctgcgtcgcctgggtcaccactttgtcgttctccatcactttcatggaacggaacttccacactttgatcggcttgccatccatgccgtagcgagtctggcggaaaataaccggccctggtgaactgagtttcaccgccagcgcaatacagcacagcaccggggagatcagcagcagaataagcgtcgccagcacaatgtcttccgcacgtttgagcaggcggttaaccccggaaagcggcgtgtcgtaaagcggcaccaccggtacgccgttcatctcttcgaggcgtgaatggagaatgttgaaggtaaagacgtcggggatcagcagcaccgaacaggtggtgtccgccagttgatggaccagttttttcactcgcgcgccgtcgcacatttgcatcgcgatatagacgttatgaatcttgcccgctttcgcgtcctcgaccagctgttgcaggttacccgcccagtcgttagaaacgccgcccggtttcgggtcgtggtaaacgcccaccacttcaaaccctaaccacggctggttacggaagctctccatcagcatttgcccggcggctaaatcccccgccaccgcgaccatgcgcttgttatagccatgattacgcagccagcccgccccaatgcgaatacacgaacggcaaaccaccagtccgatgctggtcagcgcataccacgccagccagattttcagttgcgtgtcgaaatcattgttgaacgccaccagtccggcgctgaaaatcacgcttaaggtccagttttgtagcaacagggcaaattctgtcgctgcccgaacaccgcgccatgagcgataaaaatcggtgatgccgcccagcatctggaacaccaccagcgtaatcagcgccaccaacaggtgcatgtagaggaatgacagtccgctgacttcgcaaaccagccatagtccggcaaacatgatggtgatatctgaaaagcgttgcaccatagagattaacgatgcattggttttcgctcgctcgcgcttttttagatttgtcatcgttgttcctgttattagccccttacccgcagtggggtaagggaagatccgacattactcgttcagcaacgtcagcagagttcgcgttcgcgcttccatcagcggcacatcaccgcgcgattccacattcaggcgcaccaccggttcggtattggaggtgcgcaggttaaagcgccagtcggcaaaggtcatgctgatgccatcggtgcgatccaccgccagcgcctcacggctaaaatgctgttccacgcggttaatcgcctcaacgggttgcgccagtttgctgttgatctcaccgcttgccggaaacgccgccatccggtcgcgtaccagttcgcccagcgttttatctttcaggcacaccagttcggcgaccagcagccacgggatcatgccgctgtcgcagtaagcgaaatcacggaagtaatggtgggcgctcatttcgccaccatagatggcgtcttccttgcgcatacgttctttaataaaggcgtgtccggttttcgacattaccggcgtgccacctgcggcagtcaccacatcaacggtgttccaggagagacgtggatcgtggatgatcttcgcgccgggatttttttcgaggaatgcttctgccaacaggccgacaatgtagtagccctcaataaactgccctttttcgtcaaacaggaaacagcggtcaaaatcgccatcaaaagcaatgcccatatccgcgccgtgtttgatgaccgcattgcgggtgtcgtcgcggcattccggcagtagtgggttaggaataccgttggggaaattgccgtccggcgtgttgtgcactttgattaattccacgggcgcgccgagggctttaaagcgggcttcaatggcgtccaccaccggacccgctgcgccgttcccggagttgatcaccagcttgagcggcgtgaggtttttgacattgatataaccgaacaggtgatcaacgtaagcgtcacgcaggttgatttgctgatagcgaccgcgtttggtttcatcgacgggaggaaagtcgttggcttcagccagacgctggacgtcgcgcagtccggtatctccgctgatcgggcgagccccctcgcgaaccagcttcatgccgttataatccatcggattatggctggcggtaacttcaatgccgccatccacgccgagatggaacgtggcgaaatagatctcttcggtgccggacataccaatatccagcacgtcaacgcccgcatcctgtaaacctttcgccagcgccagttttaaggtttcgctggtgaggcggacatcaccgcctaacacaatggttttcggtttgagaaattcgccataggcgcgaccaatgcgccaggcgatatcttcattcagttcttcgcctaatttcccgcgaatatcataggctttaaagcaggttaattttttcatatcgttaccctttttcaggcaatagttggccctgaccgaagcggccaattttatttttgtcgttatttacaccgcggtttcgcattcattgcctgatgcgacgtttacacccgtccgtagcgatccgcgaaacgcaccacatcatcctcttcgagataagagccggagcgcacttcaattaaatcgagcggaattttccccgggttttccaggcaatgcgtcgcccccagcggaatataaatggactcgttttcaccaagcagtttgatatcaccatcaatggtgacttttgccgttcccgcgacaaccacccagtgttccgcgcggtgatggtgcatctgtaccgacaagccctcgcccggtttcacggtgatgcgtttcacctggtagcggtcgcccgcgtcgatagagtcatatttgccccacggacgatacacttcgcgatgcacccgatgctcatggcgaccatcggctttgatctgctcgaccacttttttcacatcctgtaccgcgttacggtcggcaatcagcaccgcatctttggtctgcaccactaccagatctttcaccccgacggtggtgaccaggccagattcagcatacacatagctgttttcagttttgtgattaatcacatcgccgtggcaaacgttgccctcggcggtgtgggcgctgatctcccataatgaagaccaggagccaacatcgctccagcccgcatccatcggcaccacaacagcatctgccgtacgttccatgaccgcgtaatccaccgactcttccgggcaggcgagaaacgcttcttcatccacgcgaataaaattgagatccggatcgacggcgctcatcgctttttcacaggcatcgaggatatccgggcgatattttttcagttcttcgagatagcgtccggcgcggaacaggaacataccgctgttccagtaatattcgccgcttgccacataggcctgagcggtttccagattcggtttttcgacaaactgcgccacttcaaaggccaccatatcctgctcacccgcagacacttcaccgcgacgaatatagccataaccggtttctggtagatccggcacaatgccgaaggtcaccagcttgcccgcttcggcatatggcatggcattacgcacggcggcacggaacgcgtcttcatcggcaatcacatgatccgccgccaataccagcattaacgggtcgctctccgggctatgacgttttgccgccagcgccgccagcgcaatggcaggtgccgtgtttcgccctgccggttcgagaataatgttctcggtaagtttgttcagttgacgcagctgttccgcgacaataaagcggtgctgctcattgcaaatcaccaccgggctttcgcactccacgccgttcaggcggcagatggtggtttgcagcatggtgagatcgcctttcaggcataaaaactgcttgggataaagtacgcgggaaagcggccataagcggctaccggagccacctgccatcacaactggatagagtttcgactgcgccataattatccccgaatatcatttataaattgacgtaacacgttctctttatcgagcgtgcgttcggcatattcacgtgccaccgtgttgtgtttgggcagcaggagcgcctgacggatccccgccaccagcgcctcgaccgattccggttcaacgcaaaccgcaatgcccggaaaggtttcgcaaagctgccccagttctgtgtaggcttcagcagtaatcaccgcgttaccgcctactgccagaatattggtcagtttcgacggcaatacggcatctgccgcgccgcgtttttgcaccaccagatggcaatcgcccatcttcagcagtgcgggtaaagcgtcatacgattgcagcgggaaaaattgcatgttgcgcagtccacgctgctgcgccattttttccagccgcgctttgccgccgccctgcccgacaatggcaaaaatcagcggttcatcgcgcagacgatcggcagcttcaataacgttttccagcccctgcttttcaccaatattgccggagtaaagaatgatttttttgttatccggcaggtcaagctggttacgaagggcatcaacatcggcatctgcaacatgctgaaaacgggcaatttccgaccagttggggaagaagatgacgttttccgccgccacgcctttttcgatggctttattcatcatcgaacgcgaaatcgtggagacgttatcgacgttatgcagtccgctacgttcgaacgccgttgccagctgtgccactttgccgcctttgccttttccggcaaggcccagccccagcatggcgtccacttcgtaatcctgaatatgcagcacggtacgcgcaccagagagtttcgccagcaggcgcattcccggcgcgcaaaacagcgttggcaccacgccaataatgcgatccggcttccagcgacgttgcgccatcagcggaaagaaactgctgacggcaaaactgcccagatgcaacaggcgtttcagggtgctcggctgttttggcacatacagcgggcagcgccacaccgtggcggccccctcttctcgtttgtagcgccaggcggaatagttctcgcccacctgccattgcgggtagtaaggcggtgcggtaatgacccgcacctcatgaccttgtgccgccagccattccaccatctcgccggtgtatttgccgatgccggttaactccggcgagtagttaatgccgtagaccagtattttcataatccgggtactccggtacgcttctcagcgagaaaataggcgcggctgttagcatgaacattatcactggcgagcagcgcgtccgacgtcagccagcggtaatcgtcatgctgctcatccggcagtaacagctcttcttccgatactctgaagcgaaaaccgagcaccacatagtgagtggtgaaatccgtgccagagaagttatcgtcataaaagtgctgccagacaccgtaaaactggcctgctgttatcggcaaacgcagccccagttccgccatcgtcagccgctcaaatgcggcttccagcgtttcgtctttctgcacgcgccctcccggcacaaaccagtaaccctgcgccgggcggttggttcttttgccaagcagaaactcgccgcgactgttctcgacaataaagtcgagagagacaagcggagtggagcgcactaccgtggcaaagtcttcctgacgtaaaaacatcattacccccgaaagcggtcttgattctcaaggaaccactggtaagtgctggcaagccccgcttccagtgagatttcgtgataccagccaagctgatgcaggcgcgtcacatccagcagtttgcgcggcgtgccatccggtttgctggcatcaaaaaccacccggcctttgtaacccaccactttggcgatggtttgcgccagctcgcggatagtgcagtcaacgcccgtgccgacgttaatgtgcgacaacatcggctgggtgttctccagccagacttcatgcgccagctccatgacatgaatgctcgccgccgccatatcatcgacgtgcagaaattcgcgcatcggtgtaccgctgccccataccaccacgtccggcgcattctgtgccgtcgcctcgtggaagcgacgcagcaatgctgggatcacatgcgaattactcgggtggaagttgtcgtgtggcccgtacaggttggtcggcatgactgagcggtaatcgcgtccgtactggcggttgtatgattcgcacagtttgatcccggcgattttggcaatagcataaggctcgttagtcggctccagcgtgccctgcaacaactcgctttctgccatcggctgttttgccagtttcgggtagatgcaggacgatccgagaaacagcagtttgttcacgtcgttctgatgcgcggcgtgaatgatgttgctctcaatcatcatgttctggtagatgaaatccgccggataggtgttgttggcaacaatgccgcccactttcgccgccgccagatagacctggtcaatacgttcgctggcaaagaaatcatgcacggcgcggctgtccagcaggttcagctcgtcgcgggtgcgtaataccagttccacatcaccgcgctgttcgagctgccgcctgatggcggaaccgaccatcccgcgatgaccagcaataaaaactcgttgtttactcatgcttatgactccagcgcgatcgccacgtcgtagccgtgagatttcagcagagagtgttttttcgccgcttcgaggtcattagccaccatttcagacaccatctctctgagggtgatttccggtttccagcccagtttttcgtgcgctttggtcgggtcgccgagcagcgtttcaacttcagccggacggaagtaacgcgggtcaacagcgataatcacatcacccggtttaacgcccggcgcgtcatgcccggtgacggaaaccacaatgcccttctcttcaacgcccgtgccttcaaagcgcagtttgatgcccagctgtgctgccgccatttccacgaactgacgcacggagtactgaacgccggtcgcgataacgaaatcttccggctgttcctgctgcagcatcatccactgcatttttacgtagtctttggcgtggccccagtcacgcagggaatccatattgccgaggtacaggcacgactccagcccctgggcgatgttggcgattgcgcgggtgattttgcgggtaacgaaggtttcgccgcggcgcggggattcatggttgaagagaattccgttacaggcgtacatgccgtaggattcacggtagttaacggtgatccagtaggcgtacagtttggcgaccgcatacggagatcgcgggtagaacggcgtggtctctttctgcggaatttcctgcaccagaccatacagttcagaggtggaagcctgatagaaacgagttttcttttccagaccgaggaagcggatcgcctccagcaggcgcagcgtacccatcgcgtcgacgtcagcggtatattctggtgactcaaaagagaccgcaacgtggctcattgcgcccaggttgtacacttcatccggctgtacttcacgcaaaatgcgcgtcaggttagaggtatcactcaggtcgccataatgcagatggaatttcgggttgcaggtgtgcggatcctgataaatgtgatccacgcgctcggtgttgaatgacgatgcgcgacgcttaataccatgcacctcgtaacctttttccagcagaaactctgccaggtaagaaccgtcttgtccggttacaccggtgatgagagcgacttttgacatgtattattcctctgtatttttgaatttattcagtttcaacgcgttcgcgtatcaccactgcgggattcccccggcaaaccacatttgccggaagcgatttaaaaacactgcttcgtgcacccacgacggtgccgtcgccgattgtgacgcctggggcaacaaagacatcggttgccagccagcatttctcgccaatcacaataggcgtggcgttaatggtgaaatgttgacttgcatggtcgtggctaccggtgcataaataacttttttgcgatatcaccgaatgtgcgccaatggttatttcaccgagggtatataaattgacgtcatcgccgacccacgcgtaatcacctaaggttaatttccacggataggtaatttttactgacggacgaataactacgttttttcctatttttgctccgaataaacgtaataaaaaagcccgccagcgatacaatacttgtggcgaccaggcaaatattgttgcctgtactgcccaccataattgcactttaatagcgttgccgccccggaaccctttcggcaccgagaaaccgcttaaatcttgcattggttttccttatattcagactttgttatataaggctttcgtctttgaggtagtacgttggcgtaaatgccaggataattcagcccaaaagccaggcacatgtaatatttgtcgttggacttttttcgcgtcagcacacaattccatattattggtggtagataccccacccatggaaaattcagacaccaggccattgagttttttaaatgcataaccggctttatacattttggctgccagcgcgtagtcggaagaaactttatattccaggtcataacgccattttttcaagccggatacagggaaaaatatcgcctgatgactggcgggcaggctgtgataaatataccagcccggtttggcgctacgtttaattttatgcccgtcgccaaaatccagcagcgcatcgccggtgatcatcacgttatctttttgcatttttaacttacggacaaaatttgcggcattctgatgaaaaatatcgcccgaattgagaaacaacgcgaacttgccttgtgccatcgcaatgcctttgttcatggcgtcgtagataccgttatctggctcgctgacaaagcgtaggttaaagataccattgagattttccagatactcacgggtgccgtcgttggaaccgccatcgacaacaatccattcgaagctgatatcttccacctgcgccagatgcgccagcgaggcatgtgttttgactatcccttcgaggttacgaaacgcgacagtgattatgctaagcaacatgttcttattcttacctcgtaatatttaacgcttttcgcaaaataaacggacagacgattaaaaatgcatattccgggctaaatatcgaaccggtaaaaaacagcgataccggagtaaaaagatataattgcacgcgaaaattgcggttatcaccaaaagcgttgatcatcatttttatcactttccccatgtaccacagtgataaaaacaccgcgaaccaggaaaaataaataatcagcagatacaaaccattgtctatggtttttccgacatccgcaccgttaaatattccgaatgatgcgacatattcataaagtgagccaaatctgactacaccgtcaatatgggtcaaagaataaccgaccatcaccagcggaccgacaatacgataatatgatgacgatccttccgtacctaaatcgcccagacgggtggaaatataaggaaacgcgattaccacaccaaccaggaatacagccagagaaatcaatgctaacggtaactttttcttaatcgcctctttattcagatattgaaatgcccactccagcaaataaaacaggataaaggtcataacccctgaaaacgatccggataatattatccctgcgagaatcatagcatctgttttaggcgttttgataccaaactgtttgatgctgagccaaattgagattaatgccagagcgaaaaatgccggttcgaaataaagtgctgtcgtgcgcttgccgccgaatttaatgaaattcagcacatagctgttgctgtaaatcagatatttcgaaatcgactccataatactgctgccaccggtgaggataatttgtgccatctccaccgccgccagcgccaccaccagcccgaccaccagataaaagaaacgtaatatcttgcgatggttgtgtggcgaaattgttttaaaacgaatactccacaccatgccaataatgatcacaatatagacaaacagcatagttgaagtgacgtatttactggcatccagcgactgaccaaacagatagttaaacgccgtgagtcccgcgccaatccctaaggcaatcatcaattttttaacgctgatgcgttctaaaaacagcagtaacaagacaggtaaaaaagtgacgatggtgatggggaaactttcgccaagctgggcgattttgacgttaaccagcagataaatcagcggcagcaacaggtagctacagattctgatagaagttgacatactcctccagcatctgttgtccactgtaggcggcgcggctgcgttggctgaactcagccagcgtggtaccaaatatcgcctgcgcgatttccggtttgcttaactgcaccagttgcagcacctcttcttcgctgacggttttaccgccggatttttgcaacacttcccgcgccgcatcgctatgggtggcaatcaccggcacgccaatcgatagcgcctcacacaaaatcagcgggtagttatcgacgcgagaactgaataccagcgcatccatctgattgagcgcgctcatcagcttacgtttgtcggtttcaaagccgtgattaaccacgttgccagcggtgaacggcgagaacttaccaaaggtatgcagttcaattttgtcgcccagcgccatcatctcgcgtaccagttgctggttagttttgccgtcgtaacgcagatcatgcgccaccaccgcgattttcggcttgccctgggtttcgcgcaccggaggcaagtccgccagaatcgcttcagttgccatatcaatgccattattgataatccggcaacgccctggaccgtacaggctattgaaagcgtcagccacatgctggctgggggaaataaactgacagcccagcgccagcatctcacggaataactggcgtttgcccgccaccagttggtgtgcgcgatcaatcttcaccggcggatagttatttaaggtcgggcatttctggcagcctgttttccagccttcgcaaccgtcggtaaaggcgcagcgtccggtaacactccagtggtcgtgcagcgtccagaccagagtgacgtccggtttatggtttttcactttttcgcaaaagcgcaccacgctcttaagatttagccagtagctgtgcagcacatgaaaatgcaggaccaccggacccgctgtgcgagtaatggtgcgatataactcattgaaattgccaaacagatcgcgattaaacagacgaaacagagcaatattcgccatcgcggtcatccgcggcgtatgtttgatgacctgcggatagttctgatggctgacgctctctttgccgcctttgccgtaaccgtagacaaaatgtgacgccagcccctgttgcagcgcacgctggtggagatctaacgccacacctgctgccccgccttccgccagtcgcacattaaattgcaaaatattcatttaattaccttcactcgcgctttttctcccaccaccagcgcgttgtccgggacagagtcgagcaccacgctgcccgcgcccacggtgacgttgttaccaagcgtgatatcaccaagaataatgacgttggcaccgagttcgacgccgttgccaatgtgtggacatgccatgttatcggcaccacgattgccgatagtgacgccgtggcgaatggtaaaatcatcccccgctaccacgtttttattgatcacgacggcgtaaccgtgatggatagtaaagcggcggccaatggtcgcggcagcctggatttcataaccgaaaaagcattcggtgataatgcgatacagcaccagcagcggggccgcccacagattgttgaggacgttctttttgcgccacaccgaacaaaaatgagcaacacgataggcaagaaccatgcagcacgggcgtaaactccagctgttggcgcgcagatcttccagcatctttagcgcccccgaataccatcagccagacgtttgccgttacgcaccgacagcagcgtcagcaaagtgcgccaggtcatacgtttattgcggatctggtagagggtaaacagctgatattttttgctggcgcggtcgaatttgtctttgtgcttgcggtaaaagtggaagtacccggagaattttttcggtgacgaggtgatctgcatttcaccgtgattgatatgcaggatctgcgtcgcctcttctactttccacggttcgccgtactccaccaccatccgcaggaagatgtcgtaatcctgtgccgctttcagttcggtatcgaacaaacactctttgaaacgccatgcccaggtaaagacctggttgccaatgatattgcgtttgtagaacaggcggcgtgaatacggcgatttgggatacagcggcaagcttgccggttgggaatagacttcgccctggcaaacgtagtcgttagcgtacaaaaaggcgtgtgtgaccagttgctgtttatgggcgaggaagacgctcagacggttgggtgtccattcgtcatcgtcatcaatcccggtgatatattccccttgcgccagcataatcgcctggttacgtaccgcgcacgccccgctgttaatgtcgttgtgaatgtaagtgatacgcggatcgttgagggcggtgacgtactgttgcagttgttcccaggaggtggagcaatcatccacgatgatcatctcccagttgctgtagtcctggcgcaaaaccgattttattgcccgaatcgccagttgttggcggttccaggtcggcatatagattgagatcagcggattgtttttcataggttgttctcccggcttatgagctggtttgcttgccggatgcggcgtgaacgccttatccggcctacggggcggtgcgaatgcaggcgtcgttatttcgcatccgacttatattcgtattcgtaatagccataatcctgatacgcgctggcgcggcggaagatggagttcagaatcacccctttcaccggaataccgttttgctcaaagcggctcagactggtttccacttctttcaatgtgttgaccgcataacgcgccaccattaacgtggttccgacatgacgaccaacaattgccgcatcggtcactgccagaatcggcggcgtatcaatcaacaccaggtcatagtttttactcgcccagttcaccagttcggcaaagcgttcgctcatcaacagttcagaaggatttggcggcacctgaccgcgcgggatcaggtcaaatttggcaatagaggtcggtttagcagcggtagtaatatcgccctgaccaatcagaatttccgacaggccattaacgttattagtgcccaacagctcgtgggtgtagcctttgcgcatatcgcagtcgatcaacaacacgcgtttattggtctggctgatcaccgccgccaggttggcgcagacaaaggttttaccaattgacgggctaaccccggtcatcatcaacacattgttctgtgcctgcatcatcgcgaagtgcaaactggtacgcagactacggatggcttcaatcgccagatcggttggattccccaccgccagtagctggctctgtttatagcgtttaatccctttgatggttttgacgctatcacgcgctttctgccattccgacagcgggatgctggcatagacgctaataccgtgttcttccagtacttgcgggctttcaatgccgcgattaaacaacgagcgcagcagcacacccacgatagaaagcatcaggccaaggataatcgcgccgaggataatcagccctttcttcggtttcagcacgccaggctgagtgattgccgggtcaacaatgcgcacatcgccgacggtgctggcctcggtgattttcagctcctgctctttattcagcagttgcatatagacctgctgaccagactcgacatcgcgggtcagacggacaatctcctgctgggttttcggcatcgccgttacgcgaccgttaagtttggctttttcgtcttccagcgcctgacgtttctccagcagcgtgcggtacgccgggtgaactttggtgtacagcttggagatttccgcctctttaaaggtcagttcgttcaactgcgcatcgatgttcaccatcgaatcgagcaccgcttttgcttccagcggcagatcaacagaatctttatcctgacggaaggcattcagtttgttttcggcaacatccaagcggctacgtacttccggtaactgttgcgcgaggaaggcgaggcttttcgacgcttccgccgatttgcgctcaatattttgttcctgatagttacgggcgatgctgttaagaatgtcgcggatctgttcacgatcttcaccggtataagtcaggctcaaaacgccagcgtctttgccgttctccgttaccgtcaggctgttttgcagttggttgatcatccccagcgtggagtatttggtgacggtaaactcactgcccgggctggcgtgaatggcttcaaccatcagcgtgacgccttcttttttcagcatctggcccgcttgcccccgggcgctaaagccgccgtcgctgctcagggtgtagtttttgttgtccagcacattaagcgtaaacacctgatccgccatctctttcgggcggttaaaggtggtcactttcaccgtctcgttctgacgtcccatcaggcgatcccagcccgcaccgaaaatcgggaacgtgtttttgctcactgcaatatcgaggtcgagatcgtccaccgttttaccaagcaccagacgcgaacgaatcaactggatctcggcgtccgatgcaggcggtttgttggctaatgccgaaccaatgtcctgcactaacgaattgccgctgttttgctcgatttgtaccagtgcgtcggcactataaatcggcgtggcgaagaaggtgtaaaccacggcacagagggcgaatacggtggtgatgccaatcacccaccagcgcgcttcaatgacggtgccgaccaggcgaccaatatcgatttcatcactgcccgttaccggagcggcatgttgttttactttttctgtcattcttatacctgctctgcgttcaatgcctgcgcccactggcgggcagaccgttcaagtaatgtgtacaccgctgcaaacgtttcccggcttttgcgatacggatcggggatttcacattcgttatcccagtgaccaaacagcatcactttgccgcgcatctccggtgccatctcgcataagcgttcgatatggcgcttttccatggtcaaaatcaggtcgtagttgcgacacagacggcggctgatttgacgggcacagtgaccttccagagacagttgatgttctgcggcgacgctgatagcggtaggatcagcgcccttaccgaccagcgcgccgagtccagcggactccactttcagctccgggtgataacgttgcagtaagcgttccgccgtcggggaacggcaaatattgccgacacagacaactaagatgttgttaaacatgacgattaccagttatgaatgtcgctggctgtatccgtcatgtaacggacaccgctaatagttggcagcaactgattgatcagacggttccagcgggaaaccggggcggtggtgacatacaccacgtcataaggttgcaggcggaattctgtcgccatcaccagcgacgtggcatcggacatatccagctggtagatattggcaatcttgccgttacgcccgccctcgcctttcagcggacgaatgacaaagatgccgctggcgttggaggtggtcatgtcgatgccttcagcattgcccagggcttcagtcagggtcatgccgctaaagtccattttcagggtgctctgtttcttcacttcacccatcacaaatactttcagatcatcattacgtggcacgtagagaatatcgccggggtaaagcaggcgattctggttgaggtcgccgttttgcatcagcgcctgcaaagaaatgcgctcttcacgaccattgtgtgttagcaccacgttgcgccagtcagcggtgtcggtcaggccacctgcggcgttgatggcgtcgagaatagtcagtggcacgttggtgatcgcctgttgaccggatttattcacctgaccggagatataggccttttgtgagcggaaggcggcgatattaacgtccacctgcgggtcagcgatgtacgtcgctaagcgcccggtaatatcactgcggatttcagcgagcgttttcccgactacgtggaccttgccgatatacgggtaaaacatagtgccgtcaggctgtacccagttgccggtgtcgctggagctgcggtactgaccggctggcgtggtgagttccgggtgatcccagacggtgacattaagaacgtcccccggcccgacgcgatactggtaattcgcgatctcactttccagcgtcatattggggcgcgctacattcgggcgtgggcgtaattggtcaatcaggcgcggggtcagcggataaacattcaccattttgtcgagatcgaaatcagcgtcctgctgtttgatgacgtctttgcccatcgtcgacatattgctgcccggaagtactgtgcaaccgcttatcaaggttactgacaccaataatggcatcaatttcattttggatttcatcattgtttatttatcactttggcagagtaattatcctgtgcactattaatagcaatgtcgccatgcacatttaccttgcagttaattgaataaaaatttaactggcatcagtcctaaaaaaattgatttcatccgcaggctattgacagaataattcagactggtctttcaggcatccagacacgctaccgcccctggctttttagctaccaatacactgatttagtttaatttttcacaccctctcagcatgcagtcgttgatgagaaagggttattacggaaattaacttccgaatataaggtgacattatggtaattgaatattggctttccaataatgcaggaggaagtgttacagctaacggaatagcaggcaagataacaattcggtaattggctatttttaagaattatattaagtgtcattcaatatggtttttaggagtttctttaggttgacaatatttaatatagtgtctccacatgcgatatttcttaaataatgttttattattaccacttttaattcagggataatgtgaggttattaccctcaaataatatgagataaatagtgctgcaacattgcatttttgccccgatttatccatgatcgaattgtgacatttgtcatacaacgaataggttttgtacttactatggaatggattgccgatccgtctatctgggccgggttaatcacgctgattgtgatcgaactggtcctcggcattgataacctggtctttattgccatcctcgccgaaaaactaccgccgaagcagcgtgaccgcgcacgggttaccgggctgctgctggcaatgttaatgcgcctgttactgctggcgtcaatctcctggctggtcaccctgactcaaccgctgttcagcttccgctcgtttacctttagcgcccgcgacttaatcatgctgtttggtggtttcttcctgttgttcaaagccacgatggagctgaacgaacggctggaagggaaagacagcaataatcccacacaacgcaaaggtgcgaagttctggggcgtggtgacgcaaattgtggtactggacgccattttctcactcgactcagtgattaccgccgtcgggatggtcgaccatttactggtcatgatggccgccgtggttatcgctatcagcctgatgttgatggccagcaagccgttaacgcaatttgttaacagtcacccgacgatcgttattctctgcttaagcttcctgttgatgattggctttagcctggtggcagaaggtttcggcttcgtcattccgaaaggctacctgtacgctgccattggtttctcggtgatgatcgaggcgctcaatcagttggctatctttaaccggcgacgttttctttccgctaaccagacgctgcgccagcggactaccgaagcggtaatgcgcctgcttagcgggcaaaaagaagatgcggaactggacgccgaaaccgcgtccatgctggtggatcatggtaaccagcagatctttaatccgcaggaacggcggatgattgagcgggtacttaatcttaaccagcgtaccgtcagcagcattatgacgtcgcgccacgatattgagcatatcgatctcaacgcgccggaagaagaaatccgccagttgctggagcgaaatcagcatacgcggctggtggttaccgacggtgatgacgcagaagatttgctcggtgttgttcacgttatcgacctgctacaacagtctctgcgcggcgaaccgctcaacctgcgggtgttgattcgccagccgctggtgttcccggaaaccttgccgttgttacctgccctggagcagttccgtaatgcccgcacgcactttgcttttgtggtggatgagtttggctcggtggaagggattgtgacattaagtgacgtcactgaaaccattgccggtaacttaccgaacgaagtggaagagatcgacgcccgccatgatattcagaagaatgcggacggttcctggacggcgaatggtcatatgccgctggaggatctggtgcaatatgtgccgctgccgctggatgaaaaacgtgaatatcacaccattgccgggctgttgatggagtatttgcagcgtattccaaaacctggcgaagaagttcaggtgggggattatttgcttaaaacgttgcaggtagaaagccatcgcgtgcagaaggtgcagattataccgctgcgtaaggatggcgagatggagtacgaggtgtgatggtatcggtcattttacccaatagccgaaaggaataagatgagggaaccgcgccatcggcgatttaccgccgggagcccgggttgccagggtggtggagattgagccaccctggcacgttcaccggcttgagcgttccatagtagcgaggaacatcaagtgaacggaacagccttcgatcttacatattcagaatataatgatgccgccacgaacgcctgatgcgacgctttacgcgtcttatcaggcctacaggactggtcacctggtaacctacatcttctccagcaacttcttcacatctttgccattacgggaatctttattccgctcggcccagtcattcaggcgacgtttcgcttcgtcctgtagatgtttgcgcagtaactgatccacttgcaggctgtaattgagttgctgccagttgccataaacccgcagcggtactggcgtttctttcaggaaatcaatcagtttgctttccccgttccagccacccacgacccgaatatcaaactgggtgtcgcaggtttgatctgccagattcaacatgccttcccctgtcagcgccagcacaggcgattgaccttgcatgtcgtttaacgtcacgacgccatccttcaacgtcaaatcggtggtaaagcggtcaagccgcgtcacgttatcaaagttttcagcggccttcacatcaccgccattacgctctaccgcttgctgaatcatctgctggaagttcatcccttccatgcgcgtgtcggtcatttcgacatgtgcctgtccttgccagttgtggcggaatgcgtcggcatctatgtcagcaccggagaaatcaccagccagtgacatttttccggtcaacgaaatcggatagttaaacgccttcagaatggtaccaatctcaacgttttccagccgtggctggaagtttatccgcggatttattgatgtcgcgtccagcgtgcccggcagtgaaacctgtccaccgttaagtttgccctgcagttgagtaatttccagcaaacccgacttgttggtcatttgcgtggcaacatctgtaaaattcattccgcgccagcgcacgttactggcctgcaacaaaatatcagccgtaaagccttgcagtccctgataggccggttcatcaatacgcgaagaaatgaccgggcgcggcaacgttgattggctctgcccctgctgcgcggcaccgttttcaccattcgcggtttcattaagcgggatgaggttgtcaagattcagttgcgggaattgcagcctcagctgccattccggtttctctgtcagcgtaacctgtgcttgcccgcttagcgtactatcattggcggtcaaactaatttggttaaatgaaaggcgtttatgtgactcctgccactgggcctggaaactcccctgcccctgaataccttgttttggtaaatcggcaccctgcaactgccagttaatttgttcaatagccgccgttaaatcatgcggataatcagaagcatctaccgtaccgttaagggatatcgtgagatcgcgctgatcgcgattaacccgcccggagaactcaaatgaaccacgatgttggggatcttgttccatttgcaggcgaatattgcggattgtcacctgctcgtcatcttcatgctggaacaccagcacgctgtccgccaccttaagactggatatatcaaacgaccatccgcgatcgtctgacagatccggcaaggtattgtcgcgcggtgcaaccggagcgtcttcactgcgcaccgcttccgtctgcggcgtcagttggatcactgccccttttagcatcacctgcttaacgctcagttgatgactcagtagtggtaaaagcgccacgtccagacgcatgttgtcggcgcgaaccagtggctggcttgcgccctgggcggtgagagacattcgcccggagaggatactaagctgcggccagacgtgccaacgcagtggcccgtcgagctgcaattgataaccgctacgtgcagcaacttgcttgaccatatagtcgcggaaatcattcggattcaccagcaacactaacgcagataacccggccaccagcacgaccaggagtatcatcagcgtcgtcagaaatcgtctcatggtatcctcaatgggcctgaattagtctttatcgattcggctggctaccgcgccctgctggttgcgatatttcgcatcttcacggcggttgtaaggtcgcaccgccgggccggaaagcggctcaaagctcagcgcaccaattaacatgcccggacgcagcgccagcggcagcttaccggagttgtagaactccagcacaatgcaaccagaccagcccggatcgatgcggtgcgcggtgacgtgcaccatcagccccagacgcgccagtgaggaacgcccgtccagccagcccaccagatcggctggcagcgtcaccgactccagcgtcaccgccagcgccagctctcctgggtgaagatagaacgcctcgccctcgtcgagaacgatctcatcgctcatcacgcggtcaagcgcggcgctcacttcatctttgggaccgctcagatcgataaacgctgccgtgtgaccacggaaggtacgaaatttattgcccaggcgtacatccaccgtcgcgccgttaatacgctccactggcggacgtgggttgatcgacaaacggccttcatcaagccaggcttcaatatctcggtcacacagacgcatggcattttctcctttcgcgcatcactcccttaacgccaattacgtcaagggcatactaggttatcactgaacggtacacaatttatcaagcttattcaaagaactgacttattttcgctttcaatatatcgatcgcgatgcggtttttcccgccgcgcggcacgataatgtccgcatattgtttagaaggctcaatgaattgcaggaacatcgggcgcacggttttttgatattgcgccatcactgaatccattgaacgcccacgctcgttaacgtcacgcttgatgcggcgcatcaggcagatatccagcggggtatcaacgaaaatggagaagttaagttcgtcacgcaaacgcgcatccgtcagcaacaaaatgccttcgagaatgatgaccttcttcggctcaaccgtcaccgtttctttcatacgcgtatgttcaacatagctgtaaaccggcaggtcaattgccgagccgcgtttcaacgcttgtaaatgctcaagcagcagactgtgatccatcgcgctgggatggtcgtagttggtcttaacgcgttcttccatcgacagatggctttgatctttgtaatagcagtcttcgggaattacgccgatgtgttcatcaccgacttgctcacgcaattcacgataaagggtactggcaataagactcttgccggaagccgatgcgccagcgataccgataatgacgcactgatgagactgatcagtcatatatttagcgacctgattaacctggatgttaggaagggggcgacgaagcgccaaacgcggcaattatagggatttcatccgtctgataccagtcgaatagcgttgccgcgcgctcagagttaattgttgacaaagaattcccgggggcaaattacgttgatcagttttatgtaaggtaaaaaatgttaaacgcagttgcgcaaattatccgcctttacgtcactttatgagcaattcgcatataaaatgtaaaacttttgtactagcataaacacagaaacgaatactggcgaccaggtcttgcggataaagcggtaatgagcaaacaatcacagcatgtattaattgccctgccccacccgctgcttcacctggtcagtttaggtttagtctcgtttatctttacccttttctcgcttgagctttcgcagtttggcacccaactcgccccactgtggttcccgacgtccatcatgatggtggcgttttatcgccatgccgggcgcatgtggccgggaattgcgctgagctgttcgctgggaaatatcgccgcatccatcctgcttttttccaccagctcgctgaacatgacctggacgaccatcaatattgttgaagccgtggtcggggcagtgctgctacgtaaattgctgccgtggtataaccccttgcaaaatctggctgactggctgcgtctggcactcggcagcgccattgttccgcctctgttggggggtgttctggttgtcctgctgacgcccggagacgatcctctcagggcatttttgatatgggtactgtcagaatccatcggcgctctggcactggtgccgctgggattgttatttaaaccacactatctgctgcgccatcgcaacccacggttgctttttgagtcgctgctcacgttagccatcacactgacgttaagctggctttcgatgctgtatctgccgtggccttttactttcattattgtgctgttgatgtggagcgccgtgcgtctgccacgaatggaagcctttttgatcttccttaccacggtgatgatggtgtcgctgatgatggccgcggatccctccctgcttgctacgccgcgtacgtacctgatgagccatatgccgtggctaccgtttttgctgatcctgctgcccgccaacatcatgaccatggtgatgtatgcctttcgtgcggaacgcaaacacatttccgaaagcgaaacccactttcggaacgcgatggaatattccgctatcggtatggcgttagtgggcaccgagggacaatggctgcaaaccaacaaagcgctctgccagtttctcgggtacagtcaggaagagctgcgcggactcacctttcagcaactgacctggccggaggatctcaataaagatctccaacaggttgaaaagctgataagcggtgaaataaacacctattcaatggaaaaacgctactacaaccgcaatggcgatgttgtctgggcgttgcttgccgtctcactggtgcgccacacggatggcacgccgctctattttatcgctcagattgaagacattaacgagctaaaacgcaccgaacaggtcaatcagcaactgatggagcgcatcactctggctaacgaagcgggcgggattggcatctgggagtgggagttgaagccgaatatttttagctgggataagcggatgttcgagctgtatgaaattcctccacatatcaaaccgaactggcaggtgtggtacgagtgcgtgctgccggaagatcgccagcatgccgaaaaagtgattcgtgattcgttgcaatcacgctcgccctttaaactggaatttcgcattaccgtaaaagacggtattcgccatatccgcgccctcgccaaccgggtactgaataaagaaggcgaagtcgaacgtctcctcggcatcaatatggatatgaccgaagtgaaacagcttaacgaggcattgtttcaggaaaaagagcgcctgcacattacgcttgattccatcggtgaagccgtggtctgtattgatatggcgatgaaaattacctttatgaatccagtggcggagaagatgagcggctggacgcaggaagaagcgttaggtgttccgctcctgacggtgttgcatattacttttggcgacaacggaccattaatggagaacatttacagtgccgacacctcacgttccgcgatcgagcaagatgtggtgttgcactgtcggagcggcggcagttacgacgtgcattacagtattacgccgttaagtactctggacggcagcaatattggttcggttctggtgattcaggacgttaccgaatcacgcaaaatgctgcgccagctgagctacagcgcctcccatgatgcactgacgcatctcgccaaccgcgccagttttgagaaacaactgcgtatcctgctgcaaacggtaaacagtacacatcagcgacatgccctggtgtttatcgatcttgatcgctttaaagcggtgaatgacagcgccgggcatgcggcgggtgacgctttgctgcgcgaactggcgtcgttaatgctgagtatgctgcgttccagcgacgtgctggcgcgactcggtggggatgaatttggtctgctgctaccagactgtaatgttgaaagcgcgcgttttatcgctacacgcattatcagtgccgtgaatgactatcactttatatgggaaggccgtgtgcatcgggtaggtgccagtgccgggattaccttgattgatgacaacaatcatcaggcggcagaagtgatgtcgcaggctgatatcgcctgttatgcctccaaaaatggtggccggggccgggtgacggtttacgaaccgcagcaagctgccgcacatagcgaacgggcggcgatgtcgcttgatgaacagtggcggatgattaaagagaatcagttgatgatgctcgcccacggtgtcgcttcgccacggatcccggaagcgcgtaatttgtggctgatttcacttaagctctggagttgcgaaggcgagattattgatgaacaaacatttcgtcgtagcttcagcgatccggcgcttagccatgctcttgaccgccgggtattccacgaatttttccagcaggccgcaaaagcggttgccagtaaaggcataagcatctccctccccctttccgttgccggtttgagtagcgccacgctggtgaatgatctgcttgagcagctggaaaatagccctctaccaccacggttattacatctgattattccggctgaagcgattttagatcacgcagaaagcgtgcaaaaactgcggctggcgggatgtcggatagtgctcagccaggtgggccgcgatctgcaaatcttcaactcgctgaaagcgaatatggcagattacctgctacttgatggtgagttatgcgccaacgtgcagggtaatttgatggatgagatgctgattacgattattcaggggcacgctcagcgactcgggatgaaaaccatcgccgggccagtcgttttacccttagtgatggatacgctttctggcatcggcgtcgatctgatttatggtgaggtgattgccgatgcccaaccgctggatttgctggtgaatagtagttatttcgcgattaactgaggcgtgcttccccatcgcctgatgcgacgctaacgcgtcttatcatgcctacaaatcgctcattccccaggccggataaggcgctcgcaccgcatccggcgaccaacgtcatgcttcgtctggttgccagccttccgtataccagatatgcaacagcgcataagaacgccagggcttccagcgctcggcataacggcggatttgcgccggtgtcattcccggaaatcgctgtttaatcagataatcatccggcaggaaaacatctttcgcctgccagccacgcaaagcaaaataattcgccgtccagcgcccgatacccggaaaagtttgcagcgttttcatcgcctgctccacatcgcccggtattgtcattggtaaggtgccctccagcgccgcatttgccagatgaatcagcgcctctgcccgtttcaacggcatacctaacgcttttaatgcctgcgggtctgctgctgccagccgctgaggcgtcgggaagcagatatactccggaaaatcatccagccgttcgccataaagctgtgccactctggcggtcaattttgccgccatcgccacgctcaccagttggcctaaaatcgcccgcacgccctgctcaaaagcatcaacacagccgggtaaacgcaatccgggccgcgccgcgcctaacctgcccaacgcaccgttaacaatttgtgggttacattgcagatcaaacaggcggctcattttcgccagacactctgcggcaacaggttctaaacctgcacttaaatttatgtgcagagtatggcgggctatatccggaatagcagtcaccacgccgcgatattcgcccaccgccagactacgggcataataactgtccgcgaccgtttccacactgctcaccgcacgggcggcgagaaatcccaacatccacgaccagtcatacggcggctgccagttcagggtatacatcgcatctccttattcatccgctttcagcataaacgttattcagacgctgcgctttgctttcatattccggttgtcgcgacggcaacatttcgctaaagtcacgccccttcttcaccggcatggggattatttcgtgtttattggttttgattacggtacagcaaactgttcagtggcggtcatgcgtgacggtaaaccgcatttgctaaaaatggaaaacgacagcacgctgctgccttcaatgctttgcgcgccaacgcgtgaagcggtaagcgaatggctgtaccgccatcatgatgttccggcagacgacgatgaaacgcaggcgctgttacgtcgggcgattcgttataaccgcgaagaagatatcgatgttacggcgaaaagcgtgcagttcggtctttcctcactggcacagtacattgatgatccagaagaagtgtggtttgtgaaatcaccaaaatcgttcctcggtgccagcggcttaaaaccgcagcaggtagcgctgtttgaggatctggtctgcgcaatgatgttgcacattcgccagcaggcgcaggcacagctgccagaagcgattactcaggcggtgattggtcgtccgatcaacttccaggggctgggcggtgatgaagcaaacacccaggcgcaagggattctggaacgcgcggcgaagcgtgccggattcagggacgtggtattccagtacgagccggtcgcggctgggctggattacgaagccaccttgcaggaagaaaaacgggtgctggtggtggatatcggcggtggtacgactgactgttcattgctgctgatggggccgcagtggcgttcgcgtctcgatcgtgaagccagcctgctgggtcacagtggttgccgtattggcggtaacgatctggatatcgcgctggcgtttaaaaacctgatgccactgctgggtatgggtggcgaaaccgaaaaaggcatcgccctgccgatcctgccgtggtggaatgcggttgccatcaacgacgtacctgcgcagagtgatttctacagtagtgccaacggtcgtctgcttaacgatctggtacgcgatgcccgcgaaccggaaaaagtggccctgttacagaaagtctggcgtcagcgtttaagctatcgcctggtgcgtagcgcagaagagtgcaaaattgctctttcaagcgtagcggaaacccgcgcctcactgccgtttatcagcaatgaactggctacgctgattagccagcgagggctggaaagcgccctcagccagccactgacgcggattctggaacaggtgcaactggccctggataacgcccaggaaaaaccggacgttatctacctgaccggcggtagcgcccgttctccgctgattaaaaaagcgctggcagaacagttgccgggcattccgattgcaggcggcgatgactttggctccgtcaccgccgggctggcacgctgggcggaagtggtgtttcgttaattgaaaaatggctcagcagcggcttaaatctgcctgcgcctgagccagtttttctgctgcctgacgtaacggttccatcaacggcatggtccgtgctggagcatgaaggcggaatcgctgcaactctgtcgcgccgactgtcaacgccgattccagccgatgtcgtttggcggtcattttcgccattaccgcttgtctgtctgctggcgttatcgcttcattcggcctgaacacaaaacggcgttcacagctcgctttccagtcgataaccgcctgggtcagatggtcgccaaaccctttcacttgcttaacgccacgacgggtaacatctgcggctgtttcaataccaaaagaccgtaacgccgctttacgcgcagggccaacgccgggaatagaggcaacatcaataaaaaatccctccagaaacttctgcttctgccgttcccttgcagtgtcatgaagtgctgccagagcgcgtttctcttcttccggtaacccgagaatttcgtccttcattttttcgagcatcgtccgtttggcgataaaaccttccaggccgcctacctgctggatctggcggactaaatggtcatagtccattttcgcacgattaaatgcctcacggcgttgctgaacttctgctttgtacgctttgcttgtcagactgccaataatccagatagccgccagcacaggaaccaaaataatataacgcggttctgcctgaaggccgcaaagcagcagcgataatgctgacagtgcgatctcaagcagaatgatgtattcgcgccgtaacaggcctaaaggaagcggcctgccagtcggttggaaatgatcgggtaatggcagttgcaatgctggcggtgctactgacgccatcaccatcgcccagactttcgccagcacaaaattcccgccggtggtaatgacctcttcgccgagatcaataaaatagataacaccttgattatccagcgcacaccacgggcagtcagtcaaatgagcggggtaaacatgcattgctgaaacgatacatttctttaactgttggcgtagagagtccagtgccgctacccacgctttagccgtcggacgcccggttgccacgccactttccgtgaatgcctgctgaaacatggcttcaacatcactcggtaacatcgatagcggaatagatcgtggcggcggttttaaaccacgtcgctgattatctgacgcgtaggcataacggaaatgggtaatatccgtctccagcgcattacccgcatcagagataagcggcacaccagaataaggatgccgcccaccaaacaagacgtgaaaaattagcaacgcaaggccaaaattatcgtgattttctgtgcgttcaaaaccgacaaatgatggcaaggtttgtagctctggcggcgtaaaatgcgacacgccgacttcgcataaatgcagtgtgccattggcgttaatttgaaaggagtcgctatcaatcagtaccactttgctgtcgcgacctaccataaaactgttctggtttacgtcacccacgacgtgcccgtgctcgtgaaccgtagcaaaagatgaagcaatattgcgcgcaacatagagtagaaaatcccacgcacaatgagggtaactctggcgacgatgtgccgggctatagatcatatgaatcggttctttaccagaaacttttggcatcataaaaccgataacttttccgcctcgtccaccgtgaagcgttgcctgcggccaggcgacataattcaacaactgcgcgtcagctgtcgcagccataaaggcaagtttgtcctgttttaaggcgggtggcggcgtgtgataaatcttggcgacgctatcgacaaactcctcgatatcataaaccgcgccttcaccacctttgcccagttcacggccaagagtggtcaattcacctgtcgatgtaaatacttttatatttgttttcataatatttcgcgggtagttatattatatttcaatgaataataacaactaaccattaaaattatttctatatggggaaaacccactcaagaataaaaatgataatgcaattttatcaggatacaattcaatttcggcctgataatgattaacttccacaggtttttgctaactttgactacaaagggattctggagaaaaaatgaaaaagatattacttatgttgagtctgctattttttactaccgcgggctttagtgaagtttcggatacgttagtgacgggaggttatgataaacaagcgatgtctgacgcgattaaacatgcgcggaaagaaaccgataaattcatcgaggttatgaataaaaaagatgccgatactttcgcagtcaaagccccgataaccgatcacggaagaaccgagcatttctggcttacggatgtcacttattctaacggcatgtttattggcgtaatcagcaatgaccctggtattgttacaaacgtagaatatggccaggagtggaaaatcaagaaagaagatatttcagactggatgtatacgcgcggggataaaatttacggcggttataccattgatcctttattggtcacctatccaaaagaagaagccgacgagctaagagcaaaattagttcgctaatcagccgttatatttattgtttaaactggcggttgaattgttgtcttcaaccgccatgagaaactcactctgcccacagcgccagtgccaacgttttatcatcatccgtacgctcgtttaccgccgggctggacaaaaactgctttaacaattcaggtaataaatcgagttgttcctgcgttgctgccgccagtccattgaaaaacggggtaaagaaaggcacatgaggagaattatccagcatatttaacgccagtcgctggataccatccgtaaatgctgcaactttgtgcgcacgcccagtgctggtgaaagtttccagtctggaaacggcatcttcgtcggtaatgaagtgcgtcatgttggcatattcacccgccatcggcgtgagaggcaattgcagaccgtgacccaaatctaccaccacgccgccatcgccaatctgcataatcaaggtgccgtcaggcgatgaaatcagtcccagaaatgtgcaggcaaaatcgcgaaccgctaattctttggcttccgcctcggcaaaaagtcgttgacgaatggtcagtaccatatttgtggcgaggacatcattaagccccaattccccgccctgcactttttgcgacatataagccatcgcttcattgacggcgagcatcgcgccttcgccaccctgcgagacactgcctgcgccatcagcgacaaataccgacaataatggctgctggtcatttaaccaggcaatctgcatctggcaggcatcctgacaaggcaagtccgcgctgatgtgcgacgttccaacggttgatgcatagaccagacgccagctcacactgacgtccagccttttggcgcttccagcacaacttccgttcccggcgtggagcgggaaaccgaacgcagcgaactggataaccagctaaacagttcacggaattgtaatccttgcagaggcaaaggctgacgaacgctaatttgtgccagcgtcttcatatccgccccctgaacaccgatggaaaagaaagcaaaccttttatcttcttccccccgaaacactttgttggctgcagcctgccactcatcggttggtgcaccatcggtaatcaggaaaatccacgggcgataatacgaaataccatttgcacgatactcacgtttccgctcctctaccatatccagggctttggtaatggccgcacccattggtgtatcgccctgggcaaacaggatgggcggaaaaaaattagcggcgctggtaaagggttgttccacatgcaccgggccgaacgtcacaatgccgagttccactctttttaaagccagcggatcagcaagcagttcatcacgaaaggtaaccaatccggcgttaagttcattaataggtctaccgttcatagaaccagaaacatccagcagcaaaatgcaggggcaacgtggttccgggttactggcaaaatcgctggtggcaaacgtgatttgttcgctcataagaaatcctttcttagagaattatcgaggtccggtatcataccgactgcaataatgaaataagagcaaacgaagaaactttcagaattaggcccggcggcgcagaaaattttgctattcgcctcgcaagaacggagagccgtcgattgacactaagggcggagtgacataatttcaggagtgagggttagggagaggtttccccctccccctggtgttcttagtaagcctggaagctaatcactaagagtatcaccagtatgatgacgtgcttcatcataaccctttccttattaaaagccctcttctccgggagaggctttcccgtttcagcgtcccgctgaaatcatcggcttacctcctttcgccctgaatgcagtctatcgctaacgcgtgaataaaatagtttcctctgtgattattgcgtaacgactcgcaaagaatatttgctggcaggatcgcagactacaaagcctgcggattgacaatcttatcgtgaaggcatactttcaggagtgagggtagagcggggtttcccccgccctggtagtcttagtaagcggggaagcttatgactaagagcaccacgatgatgagtagcttcatcatgaccctttccttatttatggccccttcctcgggaggggctttcccgtttcagcgtcccgctgaaatcgtcggcttacctcctttcgccatgcaagcagtctatcgctaacgcgtagataaaatagtttcctgtgttattactggatgcgtgctcgcaaatgtgcccgtcattcagacgattccagacagtgtttcataattcctccatttttctcccttattggctggctacactagtatcattccgcgaaacgtttcaggaagagaaactcttaacgatgaaaggtagttataaatcccgttgggtaatcgtaatcgtggtggttatcgccgccatcgccgcattctggttctggcaaggccgcaatgactcccggagtgcagccccaggggcgacgaaacaagcgcagcaatcgccagcgggtggtcgacgtggtatgcgttccggcccattagccccggttcaggcggcgaccgccgtagaacaggcagttccgcgttacctcaccgggcttggcaccattaccgccgctaataccgttacggtgcgcagccgcgtggacggccaactgatagcgttacatttccaggaaggccagcaggtcaaagcaggcgatttactggcagaaattgaccccagccagttcaaagttgcattagcacaagcccagggccaactggcaaaagataaagccacgcttgccaacgcccgccgtgacctggcgcgttatcaacaactggcaaaaaccaatctcgtttcccgccaggagctggatgcccaacaggcgctggtcagtgaaaccgaaggcaccattaaggctgatgaagcaagcgttgccagcgcgcagctgcaactcgactggagccggattaccgcaccagtcgatggtcgcgttggtctcaagcaggttgatgttggtaaccaaatctccagtggtgataccaccgggatcgtggtgatcacccagacgcatcctatcgatttagtctttaccctgccggaaagcgatatcgctaccgtagtgcaggcgcagaaagccggaaaaccgctggtggtagaagcctgggatcgcaccaactcgaagaaattaagtgaaggcacgctgttaagtctagataaccaaatcgatgccactaccggtacgattaaagtgaaagcacgctttaataatcaggatgatgcgctgtttcccaatcagtttgttaacgcgcgcatgttagtcgacaccgaacaaaacgccgtagtgatcccaacagccgccctgcaaatgggcaatgaaggccattttgtctgggtgctgaatagcgaaaacaaggtcagcaaacatctggtgacgccgggcattcaggacagtcagaaagtggtgatccgtgcaggtatttctgcgggcgatcgcgtggtgacagacggcattgatcgcctgaccgaaggggcgaaagtggaagtggtggaagcccagagcgccactactccggaagagaaagccaccagccgcgaatacgcgaaaaaaggagcacgctcctgatgcaggtgttacccccgagcagcacaggcggcccgtcgcgcctgtttattatgcgtcctgtggccaccacgctgctgatggtggcgatcttactcgccgggattatcggttatcgcgccctgcccgtttcggcgctgccggaagtggactatccgaccattcaggtggtcacgctctacccaggtgccagcccggatgtcatgacctctgccgttaccgcgccgctagaacgccagttcgggcagatgtctggcctgaaacagatgtcgtcgcaaagttccggcggtgcgtcagttatcactttgcagttccagctaacattaccgctcgatgtcgccgagcaggaagtgcaggccgcgattaacgctgcgaccaacttgttgccgagcgatctgcctaacccgccggtttacagcaaagtgaacccggcagatccgccgatcatgacgctcgccgtcacctcaaccgccatgccgatgacgcaagtggaagatatggtggaaacccgcgtcgcgcagaaaatctcgcagatttccggcgtcggcctggtgacgctttccggcggtcagcgtccggctgttcgcgtcaaacttaacgctcaggcgattgccgccctcggcctgaccagcgaaaccgtgcgcaccgccattaccggcgctaacgttaactcggcaaaaggtagcctcgacggcccttcccgtgcggtcacgctttccgcgaacgaccagatgcaatccgccgaagagtatcgccagctaatcatcgcctaccagaacggcgcgccaattcgtctgggcgatgtcgcaactgtagagcaaggtgcagaaaacagctggctcggcgcgtgggcgaacaaagaacaggccattgtgatgaatgttcagcgccagcccggtgctaacattatctccaccgccgacagcattcggcagatgctgccacagctcactgagagtctgccgaaatcggtgaaggtgacagtgctttccgatcgcaccaccaatatccgcgcatccgtcgatgatactcagtttgaattgatgatggctatcgcgctggtagtcatgattatctacctgtttttgcgcaatattccggcgaccatcattcccggtgttgctgtaccgctgtcgttaatcggcactttcgcggttatggtgtttctcgatttttcaatcaataacctgacactgatggcgttaactatcgccaccggattcgtggtcgatgacgccatcgtggtgatcgaaaacatttcccgctatatcgaaaaaggcgaaaaaccgttggcggcggcgctcaagggcgcaggtgaaatcggctttaccattatctcgctgaccttctcactgattgcggtgttgatcccactgctgtttatgggcgatatcgtcgggcgactgttccgcgaatttgctattaccctggcggtagcgattttgatctcagcggtggtgtcgctgaccctgacaccgatgatgtgcgcgcggatgctcagccaggagtcgttgcgtaaacagaaccgcttctcccgtgcctcggaaaaaatgttcgacaggataatcgccgcctatggtcgtggactggcgaaagtgctgaatcatccgtggctgaccttaagcgtggcactcagcacgctgctgcttagcgtgctgctgtgggtgttcattccgaaaggtttcttcccggtacaggacaatggcattattcagggcactttgcaggcaccgcaatccagctcctttgccaatatggcccagcgacaacgccaggtcgcggacgtgattttgcaggatccggcagtgcaaagcctgacctcatttgttggcgttgatggcactaacccgtcgctgaacagtgcacgtttacaaatcaacctcaaaccgttggatgaacgtgatgatcgggtgcaaaaagtcatcgcccgtctgcaaacggcggtagataaagtgccgggcgtcgatctcttcctgcaaccaacgcaggatctgactattgatactcaggtcagccgcacccagtaccagtttaccttgcaggccacgtcactggatgcgctcagtacctgggtgccacagttgatggaaaaactccagcaactgccacagctttctgatgtctccagcgactggcaggacaaagggctggtggcgtatgtcaatgttgatcgcgacagcgccagccgtctggggatcagcatggcggatgtcgataacgccctgtacaacgcgtttggtcagcggctgatttccactatttatactcaggccaaccagtatcgcgtggtgctggagcacaacaccgaaaataccccaggcctcgcggcgctggataccattcgcctgaccagcagcgacggcggcgtggtgccgctaagctcaattgccaaaattgagcagcgttttgcgccgctctccatcaaccatctggatcagttcccggtaacgaccatctcctttaacgtgccggataactattcgctgggcgatgcggtgcaggcgattatggacaccgaaaagacgctgaatctgccggtggatatcaccacgcagttccagggcagcaccctcgccttccagtcggcgctgggcagcactgtctggctgattgtcgcggcggtggtggcgatgtatatcgtgctcggcattctgtacgagagctttattcacccgatcaccattctctcgacgctacccaccgcaggggttggcgcactgctggcgttgctgattgctggtagcgaactggatgtgattgcgattatcggcattattttgctgatcggtatcgtgaagaagaacgccatcatgatgatcgacttcgcgctggctgctgagcgcgagcaaggcatgtcgccgcgcgaggcaatctaccaggcttgtctgttgcgttttcgtccgatcctgatgaccactctggcggctctgcttggcgcgctgccgctgatgttgagtaccggggtcggcgcggaactgcgtcgtccgttaggtatcggcatggtcggcggtctgattgtcagccaggtgctgacgctgtttaccacgccggtgatttatttgctgttcgaccgcctggcattgtggaccaaaagccgctttgcccgtcatgaagaggaggcgtaagtgaagttttttgccctcttcatttaccgcccggtggcgacgattttactgtcggttgccattaccctgtgcggcatactgggcttccgtatgctgccggtcgccccgctgccgcaggtcgattttccggtgattatcgtcagcgcctcgctgcccggtgcgtcaccagaaacaatggcgtcttccgttgccacgccgctggagcgctcacttgggcgcattgccggagtcagtgaaatgacctccagcagttcgctcggcagcacgcgtattattttgcagtttgattttgaccgggatatcaacggcgcagcgcgtgatgtgcaggcggcgatcaacgctgcacaaagtttgctgcccagtgggatgcccagccgcccgacctatcgcaaagcgaacccgtcggatgcgccaattatgatcctcacgctgacgtccgatacttattcgcagggtgaactgtacgatttcgcctcgacgcagctggctccgacgatttcgcaaatcgacggtgttggtgatgtcgatgtcggaggcagctcactgcccgccgtacgcgtcgggctgaatccgcaggcgctgtttaatcagggcgtgtcgctggacgacgtacgcaccgccgtcagcaatgccaacgtgcgtaaaccgcagggcgcgctggaagatggcactcaccgctggcagatccagaccaatgatgagctaaaaaccgccgctgaatatcagccgttgattattcactacaacaacggcggcgcggttcgtctgggcgatgtggcgacggtgaccgactcagtgcaggatgtgcgcaacgccgggatgaccaacgccaaaccggctattttactgatgatccgcaaactgccggaagccaatattatccagacggttgacagcatccgggcaaaattaccggagttgcaggaaaccattccggcggcgattgatctgcaaattgcccaggatcgctcccccaccattcgcgcctcgctggaagaagtcgagcaaacgctgattatctcggtggcgctggtgattctggtggtgtttttattcctgcgctcgggtcgcgccactattattcccgccgtttcggtgccggtttcgctgattggtacgtttgcggcgatgtacctgtgcggattcagtctcaataacctttcgttaatggcgctcaccatcgctactggtttcgtggtggatgacgccatcgtggtgctggaaaacattgcacgtcatctggaagcgggaatgaaaccgttgcaagccgcactgcaaggtactcgcgaagtcggttttacggtgctgtcgatgagtctgtcactggtggcggtgttcctgccgctgctgttgatgggcggattgccgggccgactgttacgcgaatttgccgtgacgctttctgtcgccattggtatatcgttgctggtttctctgacattaacgccaatgatgtgtggctggatgctgaaagccagcaagccgcgcgagcaaaagcgactgcgtggttttggtcgcatgttggtagccctgcaacaaggctacggcaagtcactaaaatgggtgctcaatcatacccgtctggtgggcgtggtgctgcttggcaccattgcgctgaatatctggctgtatatctcgatcccgaaaaccttcttcccggagcaggacactggcgtgttgatgggcgggattcaggcggatcagagtatttcgtttcaggcgatgcgcggtaagttgcaggatttcatgaaaattatccgtgacgatccggcagtggataatgtcaccggctttacaggcggttcgcgagtgaacagcgggatgatgtttatcaccctcaagccacgcgacgaacgcagcgaaacggcgcagcaaattatcgaccgtctgcgcgtaaaactggcgaaagaaccgggggcgaatctgttcctgatggcggtacaggatattcgcgttggtgggcgtcagtcgaacgccagctaccagtacacgttgttatccgacgacctggcggcactgcgagaatgggagccgaaaatccgcaaaaaactggcgacgttgccggaactggcggacgtgaactccgatcagcaggataacggcgcggagatgaatctggtttacgaccgcgacaccatggcacggctgggaatcgacgtacaagccgccaacagtctgttaaataacgccttcggtcagcggcaaatctcgaccatttaccagccgatgaaccagtataaagtggtgatggaagtggatccgcgctatacccaggacatcagtgcgctggaaaaaatgttcgttatcaataacgaaggcaaagcgatcccgctgtcgtatttcgctaaatggcaaccggcgaatgccccactatcggtgaatcatcagggattatcggcggcctcgaccatttcgtttaacctgccgaccggaaaatcgctctcggacgccagtgcggcgatcgatcgcgcaatgacccagcttggtgtgccttcgacggtgcgcggcagttttgccggcacggcgcaggtgttccaggagacgatgaactcgcaggtgatcctgattatcgccgccatcgccacggtgtatatcgtgctgggtatcctttacgagagttacgtacatccgctgacgattctctccaccctgccctcggcgggcgttggagcgctgttggcgctggagctgttcaatgccccgttcagcctaatcgccctgatagggatcatgctattaatcggcatcgtgaagaaaaacgccattatgatggtcgattttgcgcttgaagcccaacggcacggtaacctgacgccgcaggaagctattttccaggcctgtctgctgcgttttcgcccgattatgatgactaccctggcggcgctgtttggtgcgctgccgctggtattgtcgggcggcgacggctcggagctgcggcaacccctggggatcaccattgtcggcggactggtaatgagccagctccttacgctgtataccacgccggtggtgtatctctttttcgaccgtctgcggctgcgtttttcgcgtaaacctaaacaaacggtaaccgagtaaatgacagatcttcccgacagcacccgttggcaattgtggattgtggctttcggcttctttatgcagtcgctggacaccaccatcgtaaacaccgcccttccctcaatggcgcaaagcctcggggaaagtccgttgcatatgcacatggtcattgtctcttatgtgctgaccgtggcggtgatgctgcccgccagcggctggctggcggacaaagtcggcgtgcgcaatattttctttaccgccatcgtgctgtttactctcggttcactgttttgcgcgctttccggcacgctgaacgaactgttgctggcacgcgcgttacagggcgttggcggcgcgatgatggtgccggtcggcagattgacggtgatgaaaatcgtaccgcgcgagcaatatatggcggcgatgacctttgtcacgttacccggtcaggtcggtccgctgctcggtccggcgctcggcggtctgctggtggagtacgcatcgtggcactggatctttttgatcaacattccggtggggattatcggtgcgatcgccacattgctgttaatgccgaactacaccatgcagacgcggcgctttgatctctccggatttttattgctggcggttggcatggcggtattaaccctggcgctggacggcagtaaaggtacaggtttatcgccgctgacgattgcaggcctggtcgcagttggcgtggtggcactggtgctttatctgctgcacgccagaaataacaaccgtgccctgttcagtctgaaactgttccgtactcgtaccttttcgctgggcctggcggggagctttgccggacgtattggcagtggcatgttgccctttatgacaccggttttcctgcaaattggcctcggtttctcgccgtttcatgccggactgatgatgatcccgatggtgcttggcagcatgggaatgaagcgaattgtggtacaggtggtgaatcgctttggttatcgtcgggtactggtagcgaccacgctgggtctgtcgctggtcaccctgttgtttatgactaccgccctgctgggctggtactacgttttgccgttcgtcctgtttttacaagggatggtcaactcgacgcgtttctcctccatgaacaccctgacgctgaaagatctcccggacaatctggcgagcagcggcaacagcctgctgtcgatgattatgcaattgtcgatgagtatcggcgtcactatcgccgggctgttgctgggactttttggttcacagcatgtcagcgtcgacagcggcaccacacaaaccgtctttatgtacacctggcttagcatggcgttgatcatcgcccttccggcgttcatctttgccagagtgccgaacgatacgcatcaaaatgtagctatttcgcggcgaaaaaggagcgcgcaatgaagttctggcgacccggtattaccggcaaactgtttctggcgattttcgccacctgcattgtcttgctgatcagtatgcactgggcggtgcgtatcagttttgagcgtggctttattgattacatcaagcatggtaatgaacagcgattacaactgttaagtgatgcgcttggcgagcagtatgcgcagcatggcaactggcgcttcctgcgcaacaatgatcgctttgtctttcagatcctgcgttcatttgaacacgataattcggaagataaacccggcccgggtatgccaccgcacggctggcgtacccagttctgggtggttgatcaaaacaacaaagtgctggttggtccgcgagcgccgattccacctgacggtacacggcgacccattctggtcaacggtgcggaagttggcgcggtgatcgcctcccccgttgagcggttaacgcgcaatactgatatcaatttcgataaacaacagcggcaaaccagctggttgattgtcgccctggcaacgttactcgcggcacttgccacttttctgctggcgcgcggtttactggcaccggtaaaacgacttgtcgatggcacgcacaaactggcggcgggcgatttcactacccgcgtaacgcccaccagtgaagatgaactgggcaaactggcgcaagacttcaaccagcttgccagcacactggagaaaaaccagcaaatgcggcgcgattttatggccgatatttctcacgaactgcgtacgccattagcggtgctgcgcggtgaactggaagccattcaggatggcgtgcgtaaattcacgccggagacggtggcgtctttacaggcggaggtcggtacactgaccaaactggttgacgatctccatcagttgtcgatgtctgatgaaggcgctctcgcctatcaaaaagcaccggtagatttgatcccactgctggaagtggcgggcggcgcatttcgcgaacgattcgccagtcgtggcctgaaactgcaattttccctgccagacagtattaccgtatttggcgatcgcgaccgtttaatgcagttattcaataacttactggaaaacagcctgcgctacactgacagcggcggcagcctgcaaatctctgccgggcagcgcgacaaaacggtgcgcctgacctttgccgacagtgcgccaggtgtcagtgacgatcagctacaaaaattgtttgaacgtttttatcgcaccgaaggttcccgcaaccgtgccagcggcggttccgggctggggctggcgatttgcctgaacattgttgaagcacataatggtcgcattattgctgcccattcgccttttggcggggtaagcattacagtagagttaccgctggaacgggatttacagagagaagtatgaccgagttaccaatcgacgaaaacacaccgcgtattttgatcgtggaagatgaaccgaagctggggcagttgctcattgattatctgcgtgctgcgagctatgcgccgacgcttatcagccacggcgatcaggtactgccgtatgtgcgccagacaccaccggatctgatcctgttagatctgatgctccctggcaccgatggcctgacgctgtgccgggaaattcgtcgtttttctgacattccgatcgtgatggtgacggcaaaaatcgaagagatcgatcgcctgctggggctggagattggcgcagatgattatatctgtaagccgtacagcccacgggaagtggtagcgcgcgtcaaaaccattttgcgccgttgcaaaccgcagcgcgagttgcagcaacaggatgctgaaagcccgttgattatcgacgaaggtcgttttcaggcttcatggcgcggtaaaatgcttgacctgacgcctgcggaatttcgtctgctgaaaacgctctctcacgaaccaggaaaagtgttctcccgcgagcaattgctcaatcatctttatgacgactaccgcgtagtaaccgaccgcaccatcgacagccacattaaaaacctgcgccgcaagctggaatctctcgacgccgaacagtcatttatccgcgccgtttatggcgtcggttaccgctgggaagccgacgcctgccgcatcgtttagttttagcgacattattttgttagccggagatggcgttcagaccagatccggcaacattatcccacgcatggtcagcaaactgacattatctctccgccctggcaggcatcagaaaatcgctcatactttaatcggtaaacagcacctttagatgctgttttcgatacacaatttcaatcaaggagtcattatggctggttggtttgaactcagtaagagcagtgataatcagttccggtttgtgctaaaagcgggcaatggtgagactatcctcaccagcgagctttatacctcaaaaacctctgcggaaaagggcatcgcgtcggtgcgtagcaacagcccgcaagaagaacgctatgagaaaaaaacggcaagtaacggcaaattctatttcaatctgaaagccgctaatcatcaaattatcggctccagccagatgtacgccaccgcgcaatctcgtgaaaccggaattgcctccgttaaagccaatggcacaagccagacggtgaaagacaatacgtaattacgatgccgggcgtgggttgttggcgtccggcgctttaccagagccccccacagcgctacaatgcccgcccttaaagtgggggcactcccctaaccgcttcatcaggtgaagcggatctgacctgtcatcagaacgagagaattatgtttaaaccggaactcctttccccggcgggaacgctgaaaaatatgcgttacgctttcgcttatggcgcagatgctgtttatgcgggccagccgcgttattccctgcgtgtgcgcaacaacgaattcaaccacgaaaatcttcagctcggcatcaatgaagcccacgcgctggggaaaaagttttatgtcgtggtcaacattgcaccgcacaacgccaagctgaaaacctttatccgtgacctgaaaccggtggtggaaatggggccggatgcgctgattatgtccgatccagggctgattatgctggtgcgtgagcacttccctgaaatgccgatccacctttcggtgcaggctaacgccgtgaactgggcgacggtgaaattctggcagcaaatgggcctgacccgcgtgatcctctctcgcgagctgtcgctggaagagattgaagagatccgcaatcaggtgccggatatggagatcgagatcttcgttcacggcgcgctgtgcatggcctactccggtcgctgcctgctctctggctatatcaacaagcgcgacccgaaccagggcacctgcaccaacgcctgccgctgggagtacaacgtccaggaagggaaagaagatgatgttggcaacatcgtacacaagtacgagccgattccggtgcaaaatgttgagccgacgctgggtatcggcgcaccaaccgacaaagtgtttatgatcgaagaggcccagcgtccgggcgagtatatgaccgcgtttgaagatgagcacggcacttacatcatgaactcgaaagatctgcgcgccatcgcccatgtagaacgcctgaccaaaatgggcgtgcattcgctgaaaatcgaaggtcgtaccaaatctttctactattgtgcacgcaccgcacaggtttaccgcaaagctatcgatgacgccgctgcgggaaaaccgttcgataccagcctgctggaaactctggaaggtctggcgcatcgtggctataccgaaggtttcctgcgtcgtcatactcacgacgattatcagaactacgaatacggttattcagtttctgaccgccagcagtttgttggtgagtttaccggtgagcgcaagggggacctcgcggcggtagcggtgaaaaataaattctccgttggcgacagccttgagctgatgacgccgcaaggcaacattaattttacccttgagcacatggaaaacgccaaaggcgaagctatgccgatagcaccaggcgatggttatactgtgtggctcccggtcccgcaggatcttgagctcaattacgcgctgctgatgcgtaatttctccggggaaaccacgcgtaatccccacggtaagtgattaatttcgattatttttcccggatggaaaattcttagaaaccgatcacatacagctgcatttattaaggttatcatccgtttcgctgaaaaacataacccataaaatgctagctgtaccaggaaccacctccttagcctgtgtaatctcccttacacgggcttattttttacgcgtaatacaatgaaataaaaggatttatttctggtcacgtccacacattgaccacatcgacaaaaaagcccctcgactgaggggcttcctgtttctaattacatccacataatttgctgccctgacggcaacgggtgcggccttacgacgtggacttctcccggcttcacaatgtatcgctgtaccgactcataagtgatgaacgtggcgctgcaattcacgttctgacactggtgataacgctcttttgtcgtgtcagtgatatagcggcttgtacgcgcatgtgcggcatgctggcataaaggacaatgaaacatcgcgagcacctcttccggttttgttgatggtgccattttagttaatttacccttacaaaacaaacagataaaataaaaacatcactcattatcttctgtttcgtaccccacatcagaaagcctgacctcaagctctaatgacgtcgtgaagccgctattattcagaaaatgtgtcaccttagtgattgtccagtcctgctcgtctatgacgcgcttaaagccagacactttgaccggtgtttccgtgtaaatatctgcccgaccggtagccaggctgatggagaactctgctacacgggcttatttttttatgcataagccctatctctggtaaccgtcttccattgaccacatcgatagaatcctccttcatagcacgatgcctttcacttatcggcatcgtgctcccacaggttccggctacgcacagccagaacgcgcatatttgacgcttaccaaaaaatattctcactctccacatttgaatgtcagacgagcgacaccatgtaatcctacaccttctgtcttcagctcaactatttgcatttttttgccctgagtaacacagaaatgagttgcatcattttttactatattttctgcaccagatattctacccctggctaaagaagcttcggcttcggtgtagtattggttatcgagtttacgctgaatattacttttatatgcaagaccaaatttaccgatacttgtctcatcattatgcacagcacaaccagacataataaaaatactaattaatgatatagcagctatctttttcatctcaccttcccccattaaataccaacgacactctctagtgtttaaatataataatggcatgattattataattgaataggattataataaatgttctgtacaacatttcctacataagtaggaattacggacattgaggcccttcagggtaactccatgggggctttaatatattatattgaagatgccactgtttagttgaatattaggtatatgctcttttttgaaatttatcggtggcagccgttagtattcgctgtccccattgcaagctcctggtggtaaccactgaatcctccatacttgaactgactttttatcctccgactttcatcctgttctgactccaccttttgttttctgctctacactatctacagaccaatcataaaggcacatacgatcatggcagaatttcccgccagcttactgattcttaatggcaaaagtactgacaatctacccttgcgcgaagcaattatgctgttgcgtgaggaaggaatgacgatccatgtgcgggtcacctgggagaaaggcgatgccgcacgatatgtagaggaggcccggaagtttggcgtcgcaacggtgattgccggtggtggcgatggcaccattaatgaagtttctacggcgttgattcagtgtgagggggatgacatacccgcgctgggaattttgccattaggaaccgccaatgattttgccaccagtgtagggattcctgaggcactggataaggcgctgaaactggcaattgccggtgacgccattgcgatagatatggcgcaggtcaacaaacaaacctgttttattaatatggcgacaggcggatttgggacgcgtattaccacagaaacgccggaaaaattaaaagccgcgctgggtagcgtctcttacatcattcatggcttaatgcgtatggatactctgcaaccggaccgttgtgaaatccgcggtgaaaactttcactggcaaggtgacgccctggtcattggtattggtaacgggcgtcaggccggtggcggtcagcaattgtgtccgaacgcgttaattaacgatggcttgctgcaactgcgcatttttaccggcgatgaaatacttccggctctcgtatcaaccttaaaatctgacgaagataacccgaatattatcgaaggcgcttcgtcgtggtttgatattcaggcaccacacgacatcacctttaatcttgatggcgaaccgttgagtgggcaaaattttcatattgaaatacttccggcagcgttgcgttgtcgattaccaccagattgtccactgttgcgttaatcaaactattctctcttgaaccagggagaatccgtaatgccggatgcggtgtaaacaccttatccggcatacagaacaatactacaccgtaattaattttacccgcgtcttctgcaatgccagtttatccacctctgacacagcatcatcggtaataataatgtcaattttttcgattggtagtacctgattaaaaccgcgacggttaaatttcgatgaatcgagaacggcaatcactttattagcggctgtgaccatcgcaccgctaatagaataaccttcattaaaggtcgtaataccattaaccgcatcaataccatcagcaccgacaaacattaaatcggcattaatatcctgtaatgaacgctcggcaatggaaccatgcatcgagcgcgttttatggcggaccgtgccaccacagacgaccagagtaatgtctttattttcggaaagggcaaacgctgccgggagactgttggtaatcaccgtgatatttttggcggtcattaatccttcggcgataagcattgtcgtacttccgctgtcgagaataacggtctgatcttacccagcaatagtggacacgcggctaagtgagtaaactctcagtcagaggtgactcacatgacaaaaacagtatcaaccagtaaaaaaccccgtaaacagcattcgcctgaatttcgcagtgaagccctgaagcttgctgaacgcatcggtgttactgccgcagcccgtgaactcagcctgtatgaatcacaactctacaactggcgcagtaaacagcaaaatcagcagacgtcttctgaacgtgaactggagatgtctaccgagattgcacgtctcaaacgccagctggcagaacgggatgaagagctggctatcctccaaaaggccgcgacatacttcgcgaagcgcctgaaatgaagtatgtctttattgaaaaacatcaggctgagttcagcatcaaagcaatgtgccgcgtgctccgggtggcccgcagcggctggtatacgtggtgtcagcggcggacaaggataagcacgcgtcagcagttccgccaacactgcgacagcgttgtcctcgcggcttttacccggtcaaaacagcgttacggtgccccacgcctgacggatgaactgcgtgctcagggttacccctttaacgtaaaaaccgtggcggcaagcctgcgccgtcagggactgagggcaaaggcctcccggaagttcagcccggtcagctaccgcgcacacggcctgcctgtgtcagaaaatctgttggagcaggatttttacgccagtggcccgaaccagaagtgggcaggagacatcacgtacttacgtacagatgaaggctggctgtatctggcagtggtcattgacctgtggtcacgtgccgttattggctggtcaatgtcgccacgcatgacggcgcaactggcctgcgatgccctgcagatggcgctgtggcggcgtaagaggccccggaacgttatcgttcacacggaccgtggaggccagtactgttcagcagattatcaggcgcaactgaagcggcataatctgcgtggaagtatgagcgcaaaaggttgctgctacgataatgcctgcgtggaaagcttctttcattcgctgaaagtggaatgtatccatggagaacactttatcagccgggaaataatgcgggcaacggtgtttaattatatcgaatgtgattacaatcggtggcggcggcacagttggtgtggcggcctcagtccggaacaatttgaaaacaagaacctcgcttaggcctgtgtccatattacgtgggtaggatcagtcatcccttcgtggatcattttgactgccgcctgcgctattctgttttttggcgcgctggcgagctgaaatcgctctttaaacccgacttcctgggtctcggtttcactattaccagacattattttcgccgcaccgccatgaaagcgcgtaaccacgcctttttgttcgagaaagcgcaaatcggcacggattgtcgcttccgaggcagcaaatactcccgccagatcctgaacaagcacggttccctgttcattcactaattggatgatcttattccttcgctcgaatgaattcatcgtcatttacccatattcaattgtggctagtgtaaacgaagggggaccattggtgaatgatctgttttgcacaataccgggccagcatcacgctggcccgcggtttcagggaatgagcaacactttgcccggcatagcattacgagcgatgtcacgcaccgcctgggcgaagctttcaaagcttccacggtgagcgattaatggctccaggcttaacttacgttctgtcagcaaccggctcgccgtttcccactcctgccccggccaagggctggagtagttcatccaactgccgataaccgtcagctctttacgcaatattttgccaaacgttgccgatgttaaatgcagatcctgatgcaacgtgcccaccagcgccagttgggcatgaggaccggcaatctctaccgccagttcgacagtttgcggtacgccagccgtctcgaggataagctgattaaagcgcagttcgcgtaaaacgctctgcatttgcggcgcgctcatttcgctactgttaaatgtttgcatcgcaccgaaagattttgccagtgccagtttttctgaactaatgtcgatcgccgtcacactctttgctcccagcgcgacagcgcactgaatggccagcaggccaatggttccggcaccaataataataacgtttttattctcacaaccttgcgctaaatgaaaagcatgcagaccaacggtaatcggctcaataaaagccccatcctcaataggcatatccgtgggtagagcaaagacattttttcgcttaacgacaatatattcagcaaatccaccatcacgccgcgagccaataaaatcatattttgcgcactgggaataaaaccctttcagacactctggacaagtaaaacagggtaataacggcacacaggcaaccgcatcgccagggtgtaaatcatcaacaccggatcccaccgcatcaatatagccgctaaattcatggcctaacgttattggataataatgtgcaccatttttaaatatcctgggtaaatcggaaccacataagcccgagctggcaatttttacccgcacctcatcctgatgtttaatttcaggaatgacgctttctgcaacgcgcacgataccatcagtatcattcaccactgatttcataaaaactcctgattgttaagggggataacctccccctcaggtaaaaattattctgcgagaacgactttctcttgtttaataaagccacgcgctctacgccaggtcatgaaaataccggtcagataaattgcaccgataataatgaaaccgggaatattttgcggggagaaaacctgaatcagtaaccaggtaatgggagaaccgccctgatccattgaagccaccatacccccggcttttaacgccccagcattagccgccagttgggtgtgcaaaccaatagtttgcgtcgcgatccacagggtgatgctcataatgatgacacccgagattaaggtgcggaacagatttccacgatgcacggcgaccgccatcgccacgaagaagccgatggtggcaagatcgccaaacggcagcacctgattacccggcacacaaacagcaattaaaatggtgagtgggataaaaatcaggcttgccgataccaccgccgtatgtcccagcagcaacgccggatcaaggccaatcaggaactcctgaccgccgaacttcgcctgtaaacgactacgagcctgcttagcgatgggcgttaaaccatccatgatgggtttaatcacccgtggcattagcagcatcactgccgccgtttttaccgccagctgcaatacacctttgacatcgtaacccgcgaggatgccgataatcagccccatcacaaaacccacggtgacaggctcgccaaatggaccaaatttgcgctgaatatcgtcggcgctaaatttaattcggttaacgcctgggattttctcgatgatagcatcgaccagcaccgcaatcggccccatatacgccgacgtaccgtgcggaatagcaataccttccagctcaaagaaatttcgggtatcgcgggcaaaccagtcgccgagcttataaacaaacgccgcgtgaattaccacacctgccatccctatcatccatgaaccggttgccagatgcagcaacgcgccggtgaaggtcatatgccagatattccagatatcaacatttaccacccgcgtcatacgggtcagtaacatcgccacgttaaccagaatcgcaatcggaatcgccaccagcgcaatttgcgacgcccaggtcattggtgaagagcccggccagccaacatcgaccacatgcagattcaggtcgaaattttccgccatcgctttcgccgccgggccaatggaatccagcattaagccaatcacaaggccaatgccaacaaagccaatcccgatatgcagacccgctttaaagcaatcgcctgccttcatgcctaatattttagaaaaaataatgatgacaatcggcagcatcaccgtagggccgaggtcgagaatataacgcatgacttctgaaaacataggtcacccctgtaagatagtcagaattttattttgtaatgcttcgataccgataccagaaataaaaggcatgccgtgaactaacggaatatcgccaaaactacgatccactttggcagtggtgcatatcaaatgcacaccatccatataggtttctatttcattaacccgacactggattaattcaacaggaatattatgattctgacacaactctttaatttcttccgccgccatcgtagaggtcgcaaccgcgcctccgcaagcgacaataatcttgcgtttcataaatagtcctttttattgttacagagggatttattcgtctgaatctaaaacatactttgtgaagtattcctttaactgggtttcaggaagagtgattagtgtctcgacgatatcgggctgttgtaacttgccaaataaacagcgtaaaagtttcaattgctgctgcggattttccacaatcaacgcaataaccaacgataccgccacgtcgttatcatcatccgcttgctgaaaatgaactttatttgttggccttaacagataaatggctgacgacttagcatgaatcgcctcacaatgcggtattgcaatagcgtgctgctcaagcattatcccggtagggaattctgcttctctggcaattaatgcctgtggccaggtatcatgaaccacacctttggcgagcatctcattaccgatatgggttaaaacttcgctacgatcgacaaaagaaattccgctacgaacaaacaggttagtcatataccgtccttattccgcacagccgtagcgataggcgcgcaaaacatcataaattttatccataatcagctgatgcggtattgctgataattccccggactgaatgcgttcaaattgtttgggaagatactgactaatcatgcccagtgggatgtccacgccttcaagattcaccatcatcgtttcgacgctatttttaatccgactatgcggccagtaataacgaatacgatccgacaggctgtaacgaatatccagtaatgaatcgttaaaacccgtacgataatattttttccagtattgcggttcgtcgagcatcacttcttcaattaccgccaggcaaccgctgcgattttcaggggcgataagttcctgctcaatttgtgccagtgcaaatatcgcctcgcgtaaagcaaaggttaatgcgggaccgactttcaatattgcaaagtgatcgcggactaattcccaataagccgtccgggtctggtaatcggtagaatgtgcttcataaaccattcgggtgttttctatccattgcgccagcggctgcgcttcctgcggctgataatggataatattgctgtgatcaaattccacacccggctgcaccacgatggcaatcacacgtgttaacgcctctgtcagcccacgggcaataaaggccttttgatgcgtacgtaaagtattggcggcatcttcaacatgggtgatgtgtactgactgaatggcgctggcctcaccgcccggaaccggaacttcggtgccaatgacatagctcagttgctcacgctggcaatctgtcgccacactttccgcagcaaagcaaagcacagcagctcgttccgcaaccgtttctggtgctaacggtatgggatcccccgcgcaggacattgacgcatcaagatgaattttactgaagccggcacgaacatattcctttaccagctcgacggatttttccatcgccgcatccgcattttcttgctgccagcagtttggccccagatgatcgccgccgagaataatgcgttcgcgtgcaaacccaactttatcggcaatcgtaaaaacaaattcgcgaaagtctgccggtgtcattccggtataaccgccaaattgattgacctggtttgacgttgcttcaatcagcactttgcgcgtgctgttgcgatcaaatgccagcgccgcttcgataaccaacggatgggcagaacagactgaacatatgccgatatgttcaccagctttatgccgggcaattaacgttttcatgttttttccttgttaaatggcaggtgcgttatgccctgccctcgcagccacaatcggcaatcactttgctcaccacatcgcgcattgcggatttagccgactgcaaataatcccggggatcggtcgcttcagggtgctcggtcaggtaattttttaacgcctgcgagaaggcatttttcagctccgttgcaacgttgattttgcatatccccagtttgatggtttgctgaatatccttagtcgataaccctgacgcgccatgcagcaccagcggtaagttcacccactggcgaatgttctccagtctagaaaaatcaagcgccggtgcgctggcatacatcccatgagccgtgccgatggcgaccgccagggaatcaattccggttgcctcggcaaattcacgcgcctgagcggggttggtgtacaacgcatcggcttcattgacttgcacatcatcttcctggccgccaagttgccccagctccgcctcgacgctgacatcaaagcgatggcaaaaatccaccacctctttgacccgtgaaatattttgcgcaaaaggcaaatgcgaggcgtcaatcatgactgagcgcacgccagaacgaaccttctgagcgatatcgtcaaatttcgtgtgatggtcgagatgaattgccagtggatggtgatattgcttcgccatcgcgctgaccagcgccaacagattttctgtaccagcatgagtaaatgtgccaggcgttccggcgatgatgaccggcgcatgcaggttggcagcggtttctaccaccacttgcatcgtttcgagattgtgaatattgaatgccggaaccgcataaccgccgcgctgtgcgttgttcagcatctgctttgtcgataccacgtacattttcatatcctgtcgtttgttttcgatttcaaaatataatgaaattatttgtttttaaatatcgagataacgatcacaaaaacgacaatatgaaaattattcgaggagtgaaaggcaaaaaaacggcctcccgatagggaagccgtagcaaagtgcgcgtgtttttatgccggatgcggtgtaaacatacgtggcagtgctatgtaggcatgataagacgcttcagcgtcgcatcaggcataggttgccggatgcagcgtaaacgccttatccgtcctacggggtggtgttgttcgtataaggcgtatcaggcgatagtaattttgctatcgagataaacgtcctgcacggcgttaatcagtttcacgccgtcagccatcgatttcttgaacgctttacgtccaagaatcagccccattccgcctgcgcgtttgttgataaccgcagtacgcactgcatcgctgaggtcagtttcaccgcccgcagcaccgccggagtttatcaacccagcccgacccatatagcagttagctaactgataacgcaccagatcaatcgggttttcgctggtcaatttgctgtaaacacgatcgtcggtgtaaccgtaattaattgctttatagccgccgttattttccgccattttttgtttgacgatatctgcaccgatggttgccgccagatggtttgcctgaccggtcaggtcggcggaaacatggtaatcaacgccatctttcttaaaggcggagttacgcaaataggcccacagcactgtcaccatacccagctcgtgcgcacgttcaaaagccgcagaaatttcttcaatctggcgacgtgactcttccgagccaaaatagatagtcgcaccaaccgcaaccgcgcccatgttgaacgcctgctccacgctggcatacagcgtttgatcgtaggtattcgggtaacttagcgtctcgttgtgattaagtttgacgaggaatggaatgcgatgcgcataacgccgcgataccgacgccagcacgccgtaagttgacgccacacagttacagcccgcttcgatcgccagttcaacaatgtttttcgggtcaaagtagagcgggttagcagcaaatgaagctccggcagagtgctcaacgccctggtcaaccggcagaatagaaagatatcctgtgccagccagacgcccggtgttgtacaacgtctgcatattacgtaacaccgctggcgggcgattattgtcaatcattacgcggtctacgtagtcatgtccggggagataaagctggtcagaaggaattgtcatacaacggtgctgtaaaaggttgtcggcgtctttgccaagcaactgcgcaatatctgtcattactatgctcccgtaaattccgattggatatcggctatggattgtcctggcccgccttttgcgggcaatcataatcctggtcgttacgggcgagtttttccatcttttggatgttttttcagcgttttctgttggctcgattcatcagaaaaaatgttagcgcggtcaagttttcaccgcaaaggtatttaaaaggtattattaagtggtattgtcatcgcgtaccttacattacctgtcatgaaggaattaaaagatgaaaacaacagcaaagctgtcgttcatgatgtttgttgaatggtttatctggggcgcgtggtttgtgccattgtggttgtggttaagtaaaagcggttttagtgccggagaaattggctggtcgtatgcctgtaccgccattgcggcgatcctgtcgccaattctggttggctccatcactgaccgctttttctcggcgcaaaaagtgctggcggtattgatgttcgcaggcgcgctgctgatgtatttcgctgcgcaacagaccacttttgccgggttcttcccgttactgctggcctactcgctaacctatatgccgaccattgcgctgactaacagcatcgcttttgccaacgtgccggatgttgagcgtgatttcccgcgcattcgtgtgatgggcactatcggctggattgcctccggtctggcatgtggtttcttgccgcaaatactggggtatgccgatatctcaccgactaacatcccgctgctgattaccgccggaagttctgctctgctcggtgtgtttgcgtttttcctgcccgacacgccaccaaaaagcaccggcaaaatggatattaaagtcatgctcggcctggatgcgctgatcctgctgcgcgataaaaacttcctcgtctttttcttctgttcattcctgtttgcgatgccactagcgttctattacatctttgccaacggttatctgaccgaagttggcatgaaaaacgccaccggctggatgacgctcggccagttctctgaaatcttctttatgctggcattgccgtttttcactaaacgctttggtatcaaaaaggtattattgcttggtctggtcaccgctgcgatccgctatggcttctttatttacggtagtgcggatgaatatttcacctacgcgttactgttcctcggtattttgcttcacggcgtaagttacgatttttactacgttaccgcttacatctatgtcgataaaaaagcccccgtgcatatgcgtaccgctgcgcaggggctgatcacgctctgctgccagggcttcggcagtttgctcggctatcgtcttggcggtgtgatgatggaaaagatgttcgcttatcaggaaccggtaaacggactgactttcaactggtccgggatgtggactttcggcgcggtgatgattgccattatcgccgtgctgttcatgatttttttccgcgaatccgacaacgaaattacggctatcaaggtcgatgatcgcgatattgcgttgacacaaggggaagttaaatgaaaacagaacgtattctcggtgctctttatgggcaggcgttaggggatgcgatggggatgccctccgagctttggccacgcagccgcgttaaagcacactttggctggattgaccgttttcttcctggaccaaaggagaataacgcggcctgttattttaaccgcgccgaattcaccgacgatacctcgatggcgctgtgtctggcggatgcgttactggaacgtgaaggcaagatcgatccggatctgattgggcgtaatattctcgactgggcgctgcgtttcgacgcctttaacaaaaacgtactaggtccgacctcgaagattgcgcttaacgccattcgcgacggtaaacccgttgctgaactggaaaacaacggcgtgaccaacggcgcagcgatgcgcgtctcgccattaggttgtttgcttccggcgcgtgatgttgattcctttattgatgatgtagcgctggcgtccagcccgacccataaatccgatctggcggttgcaggcgcggtagtcatcgcatgggcgatttctcgtgccattgacggagaaagctggtcagcgattgttgattccctgccttcaattgcgcgacatgcacagcaaaaacgcatcactacgttcagcgcctcactggcggcgcggctggagattgcgctgaaaattgtgcgcaatgccgacggcaccgaatccgccagcgaacagctttaccaggtcgttggcgcaggtaccagcactattgagtccgttccgtgcgccattgcgctggttgaactggcacaaaccgacccgaatcgctgcgccgtcctgtgcgctaaccttggcggcgacacagacaccatcggtgctatggcgacggcaatttgcggcgcgttgcatggcgttaacgctatcgatcctgcgttaaaggcggaactggatgcggtaaatcagcttgatttcaaccgctatgccacagcgctggcgaaatatcgtcaacaacgggaggcggtatgagcggcgctcgattacacacgctgctgcctgaattaaccacgcgtcagtcggtgatggtcgtcggcgcggcggtcattgacgtgatcgccgacgcttatgccctcccctggcgtgggtgcgatatcgaactgaaacagcagagcgttaacgttggcggctgcgcactgaatattgccgtggcgttaaagcgcctcggcatcgaagcgggtaatgccttgccgctcggtcagggcgtgtgggcggagatgattcgcaaccggatggcaaaagagggcttaatcagcctgatcgataacgccgaaggtgataacggctggtgtctggcgctggttgagccggatggcgaacgcacttttatgtcattcagcggtgttgaaaatcagtggaatcgccagtggctggcgcgattaaccgttgcgcctggcagcctgctctatttttccggttatcaactggcctcgccctgcggcgaattgttagtggaatggctggaagagctgcaagacgtgacgccgtttatcgattttggcccacgtattggcgatatcccggatgcattactggcgcggatcatggcctgtcgacctttagtgtcgctcaatcgtcaagaggctgagattgccgccgaacgttttgctttatccgcagagataacaacacttggcaagcaatggcaggagaaatttgccgcgccgttgatcgttcgtctcgataaagaaggcgcatggtatttcagcaacgacgcttctggctgcattccggcatttccaacgcaagttgtcgacaccattggggcgggcgacagtcatgccggtggcgtacttgccgggctggcctctggtctgccactggcggatgccgtattactgggcaatgcagtggcgtcgtgggttgtcgggcatcggggcggtgattgtgcgccaacgcgcgaggaactactcctcgcacacaaaaacgtatagatcgctgcgacagtggctaatgctgtactcaataggccgttgctgttggtcaagcgccacttgcttgatcaccagcaccggtattttgctatctaactgaatatgtgactgaaactcggcatccggcatccgggcgctaacgcgggaacgcgtacgttgtgggtaaatgtgctggctgcggaaatagtcataaagtgaaatcccgatggcatcaacatcatgaattaaatgcgccggaacccacgattcctcaatcgataccgcttcttcatcgacatagcgaatacgcttaagcaaaaagacatcacttcctgcttcgaccgccagctgctgcgcgacttcttcgggacatttcacgacacgcttgttaacccatagcgtatcgggctttttcccgcgcaataccacctgctgagaaaaacctcgcgcttctttcaacgagtattcgaagatgttgttgatctgcgtgccgtaaccgcgcgaacgcgtcaccacaccctcttcttccagcgcctgcatcgccttgcgcaccgtaatgcgcgaaacgccggttaactgacttaaatcacgctcaccgggcaaaatattgccatgctccagcaccccgctgcgcacggcattttttaccgtttcggcaaacttaatataaagcggcgtgttatccgccgctaaaatacgctcgttcagttgggcaatcagctgggtatgcgcttgttccatttgtctttttcctgccggggagtctggtgggagtatatcactgcttcttatttaaggcgtttctttaatcccatcaacgaatgcctgcaactcctccaccgtgccattaaatacattaaaatccaccggaccattgatgccatctacctgtccacggtcggaatgctgccagaagcgccaggccattccgtcattgtccggacgacgttgatagtagtgagccacccaccacggatattcattgaaatagcccgccagattggtgtgataaaaaacggctcctgagtaaataatcggctttttccccgtacttttttcgaccatttttagccactgacttacccgcttgcgtaattcttttgccgataattttccccgttcttctacgtccagcacggcagggaaatcgccttgtgagaaatccaccgtttgcagaaataatctcgcctgaactgaagcggataccgacggggagaaataatgatacgccccacgcagcaggccattttcgcggcttagttgccagttacgcgaaaaataggggtccaccagcttttcgccttccgtcgccttaataaaagcaaactgtaagcggataccattgtcgcgcatttttgccacccgctgccagtcgatccgctcctgccagcgcgaaacatctattccgtgaatggtgtaactggcaggaatgcgaatagcgaaagatttaaccgggcgataaccgtagaagtggatgtagtctgtaatctgaactgctgtcgaatagaaaaaattcaccgtctgacgcggataaattgcaacgatggaaattagcccaagagcgcataatagagaggtgagtttttttcgactggtaattcttagctgcattggtttcatccctgaatgtcagtgccaaaggctgacaataaccaaagcagctatagtacggtgctcaccaccaggcgtggaagtggtgaaccggaccaataccgtgaccaacttccagcgtgtcggcctgggctaacgccgatgaaagccagctttttgcctcctgtacggtgtcagcccagtttgtatggcgcgggcgtagtgcagccaacgccgcagagagtgtacaaccagtgccgtgggtgtttttggtcataatgcgcggtgcggtaaaccgttgttcaccctcgcgggtaaacagccagtccgggctttgctcatcatccagatgaccacctttcattagcactgcgccacagcccatcgccaacagcgatcgcccttgttccagcatttcctgttcggtgcgcgcgtgtggcgcgtcgagcaaggcggcagcttcgggcaagtttggcgttattaatgaaacctgtggcaataatcgactgcgcagcgtagcaaccgccgaaggtgaaagcagcgggtcgccgctttttgccagcataacggtgtcgagtaccacgttttggatctgataacgttgcaaccgttctgccaccgcttcaacaatatcggtttccgccagcataccgattttagtggtatcgattcgcacatcgctgaacaccgaatcgagctgggcggcgacaaaatcaggctcaatgcgatacaccgactgtacgccacgggtattttgcgccaccagtgcagtaataactgagcaaccataagcgccaagtgccgagaaggttttaagatcggcctgaatccccgcaccaccactcggatcagtaccggcaatcgtcagagcgttaattcgtttcatgcctgcacctcctgcgtcaattgccagagcgcatcaaggaaatgtggaacaaaactgcctggcccctcgcttctggcgactgcgcgttctccggcttgtttcatccagtgacaggcagatgcgacattttccagcgtatcgcctggtaacgcacagcaggcagcgacaaccgccgataatgcacagccagttcctaccactttggtcattaacggatcaccaccgtgaataccaatgatacgatgtccatcggtaacataatccatctcgccagtgaccacgacgattgcgccagtttcccgtgccagtgtttgtgcagcgggtatcgcgttagctgcggcgtcagtggtatccactccccgtccgccattagcaatgccagctaatgccatgatttccgaagcattaccacgtatcgctgccggtttaaaagataaaagttcatgacaaaaatggcggcgataatcgagcgcacccaccgctactggatcaagcgtccagggtgtttgagagctttttgcttgctcaacggcagcacgcatcgcctgagcgcgtggctgcgtcagtgtgccaacgttaatcaacaaggcactggcgatagccgcaaactgactggcctcttcggtttcgataaccatcgctggcgatgcaccgagcgccagcaaggtattggcggtaaaggtttgcaccacatcattggtcatgcagtgcacaagaggggaatgttggtgaaaaaggtgtaacgcgtgcgcagattgcgctgaacccagcaggtcgacttgcatagtttgctcctgccataacgtgaagaagcaatgacctggtggtccgtgacttccctacgctggcattatccagatcaggtgatacgggtatttctcagccttcacgcagaagggcaccccgagtcgtttggttgcgatgataaatcgcagaggaggatggtaatgtccagcgcacgcgttgtaaacgaggaaaaacggcagttttacaatcgcgttaataaattatttgatatatgaatccagcaccttcagaacgacatccagatcttcttcacgttttagctcatccccctggtgaacgatgtgttccgtcagatgacctttaatcacttcccgcatcagaccgtttaccgcgccacggatagcagcaatctgttgtaaaactgcagcgcattcgtgcggctcgtcgagcattttcttgagcgccacgacctggccctgaatcttactggcacgcgctttcagtttctgtttatcacggattgtatgagacatggcaacacctggttaacaagaatatgaaaaatcatagcactattaatctactggggggtagtatcaggtactgggggggagtagaatcagattgccgaattaatactaagaattattatcatgaccgaatttacaactcttcttcagcaaggaaacgcctggttcttcatccccagcgccatcttacttggtgcgcttcatggcctggaaccagggcactcaaaaacgatgatggcggcgtttatcatcgccatcaaaggcaccattaaacaagcggtgatgctcggactggcagcaactatttcgcataccgcagtggtctggttaattgcctttggcgggatggtgatcagcaagcgctttactgctcaatcagcagaaccgtggctccagctgatttccgcagtgatcattattagcaccgcgttctggatgttctggcgtacctggcgcggcgaacgcaactggctggagaatatgcacgggcatgattatgagcatcatcatcacgatcacgaacatcaccacgaccatggacatcatcaccatcacgaacatggcgagtatcaggatgcccatgcacgagcccatgccaatgacattaaacgacgctttgatggtagagaggtcaccaactggcaaattttgttatttggcttaaccggtggccttatcccctgcccggcagcaattaccgtgctgttgatatgcattcagttgaaagccctgacactgggcgcaacactggtcgtcagtttcagcattggcctggcgttaacgcttgtcaccgtaggcgttggcgcagcaatcagcgttcagcaggtcgcaaaacgctggagcggatttaacactctcgctaaacgcgccccctatttttccagtctgttgattggcttagtcggtgtgtatatgggcgtacatggcttcatgggcataatgcgataactcaatcctttaggcttgcatgttatcttcagcccaggatgattcttaaatcagctatttccgctgactctctgctcgctaaggatgcttttagggcatcctttcatttacactttttacgaaatcatgggatcactaacaaaatatcgcttgtcagttatattgtatggcaggaaagatatgcgactgatattacagatccccaaagtggagagtttatgaccattaaaaataagatgttgctgggtgcgcttttgctggttaccagtgccgcctgggccgcaccagccaccgcgggttcgaccaatacctcgggaatttctaagtatgagttaagtagtttcattgctgactttaagcatttcaaaccaggggacaccgtaccagaaatgtaccgtaccgatgagtacaacattaagcagtggcagttgcgtaacctgcccgcgcctgatgccgggacgcactggacctatatgggtggcgcgtacgtgttgatcagcgacaccgacggtaaaatcattaaagcctacgacggtgagattttttatcatcgctaaaaaaagccccctcatcatgagggggaaatgcagacaccttgttattttttattattagccacttgctcgtcttgcttgttattagtcgtatttcacgttgattaatgcggttgcctccagtgcgccagatttaactttgtttgtatcgtagacgtagtaactggctgttatcggaattgaaaccgttgtatctgtaagttttgacttcgccgcaacttcctttaaatttgtatatcctttactgctgttagtgatatttaaaagtgtgactggcgaaccattactttcaagaataaatcctacgccattatcttccgcacctttcagtattgtgttgctgttggttaacaagtcagaacttgataaatacacctgcattttccgtgatgtttgattttgttgacctaataaatttttacaacgcagaataatatccccttgtttactatttattgttgctttgttacctgtggctggtaattgtgaaacgggaatactgtctaaagtaattaataaatcgtccggtttgcaggttgtggttatcgggttgtatgacaatgtcagattaaaggaatagacacctgcattttgtgccaatgcatttctgtagctatttacacatgcatcccatgacttgccacctaataaacacagtagaaattgtactgcggcactcccgcgtgtcgatgatgaagcactggataatgtcgcaacaccattaatcatcactgaaccgccgccccccgcagaaacattcacttttgcattactggccgcaggtgtcaccgtaactgaataaccactggtgaaactggtctgattatttgacaacgtgatgttgtttttattggtccattcaaaatgtaaatttaattttatggtatcgttataaagtccaacaataatatccgacgggctcataggggtgatagtatttgtacttacgcatgacgaatcattaaaattatgctcatatgtcgccatttgtgtttgagtaagtgcaaaatccccctgaacaaccaagttgtgctgaacagataactcactataacatgccgcatagctcacaggcataaccatcatcattaatataaatagcattatgcgaatttccatagaaccacctgactattactggcaaatataatttctactttcatcaatctctttaccgaaggtgattgtgcatgaaagtccttgttgcttatcaattgccacattaaccgatggcggtacttcattggtgcgaataaataactgacttccctggccgacaacgccaatattatgaccatggatatcattgacttcataaccaaacgttaatgattgcccatctgctcttaacgcttttataaaccatggcttgcgctgatcggtatcaaaattaaccagtacaaccgcgccgcgataaggggcggcaattttccggttgccacgtaattctgcttcgctatcgctttgcgacacatccagcatcaggtgattttcccgataaggtgtcattccgtcgtatatcaccactccattacggtttgttgtgcgatatttttgcccattgacataagcatctttaattcctggcgcattcatcacagcaaacgtttcggaaagacggttcgccagattaacgccacccgaccaggcgacaatgccccctgaaacactggctccagcctgtcgataagtactcgactgactataactgccattcactgtcgcaaccggcgcgttccaggtcaaattcgccccagctgtcgtttcatttccctgatgttgatgactcaggttgacaccataattgaactgatcccgactccctactgttcctgataatcccgtattatttgaggcaaacccctgatcatcaaacgtcgttgagttagacatatatatttgccgacgaggcgtcgaaacgtcatcaccccaatcaaagggaatcgatataaaaatattaaaacgtttctcttcatgatgattctcgtcataagcctggcttgccgcgagggtatagcttatccgtcgcaggttgttggaataactcaactgataatccttactactgccgctacgcccccagtaatctcgccataacgtacttaatgacacagacccccaaccttctggcaatgactggctcatattggcggaaaagctatttttgcggccaaaatcgttctggtaataatcggcaatgtcatagacatcgttttcatcacggcgataattatctttattgtttgcccaaacgtgatcgttaaatgtccggtaatcacgcgacgaataacgccaggccgccagaccaaaacgcgtcgacgtttggctcacaaatttgttgtaggcaatttgataactttgcccgtcaaacacatcgccgttgtcttgtttactatgcgacttagtggcatcgacggaaatggcaccaatgcgtgtattccagccagcccccaaagtaaacgcgtaataattattcgcgaccatcgagccaccatacagcgtcaataaattattaaaaccatactgataacccgcctggacaaaatcactttgtttgctcgccccttcaatatggctacgacccgccgctaaatcatatttcgacacgccgggttgcagcatatttggcaccgctgcataaggcaccagataggtggttaccgagccgtccgcctctttcacgctgacatcaagatctgctccaccaccggccaactgcaaatctgtaatcgcgaacgggccaggaggaacctctttctgataaaccacaaaaccattctgttcaatagttaccagcgcgttactctgagcaatcccctgcacccgtggcgtaaaattttgtttcgagttaggcaacatctgcatatcacgaaacaaccgcacacctctgaagcgaacagaatcaaaaatatcgcttgatgtgtacatatcacccacgcgaagcgtgccgagaagttgggcaaatccacgttccagatacagggtattgcttttccacacccctggattgttatttgttttactgaaactggcatcagaatgcagttgccaccccagtaaatttaacccgctgttaaaacgtacatatgtactcttgttattacccgacgctttatagtcgctgtaatactgactcagataataagaggtataaaacgcattaataccccgctcccagttttccggtggaacatagccactttccagttcttccacccaggcctgcgggacactgaaatcgagacgaaaaaccccgatatcccaggtatagctcccaccctgaacaagttgctcaaatgttaaacattgcttaccgctggcgaagttatcgctattaatgcctaaccgcttgataacttctcttgataaacatgtttcttgcgggttgtctttaacaataatctcatatttcccgcgccattgcttattgacataaatatcgatgtcatactgccccggtaagggttgattatcatcaagacgaatatttgcaacctgctggtctttcattccacctatcataaaatgggtatcaaaggtttcttcagctgcataagcttcaatgccgagcaataacgctacgattgctgatgcaagtggggtcattctcaacataggcagctcctgcaattaaattttgtcactaatatagttgccatggtcatcgataatggtcagatgccagttatttgcattattacttttgacattaacactctgactttctaagggggcaatcataatagtttcataattgactttgacattattagctttgacatccgaaatcgtcacccaattagctgagtcattttttatcaccaaaccattgccactgcgatttaccagcaattttttaaatgtcgctttatttaccggagcaatacccgctggccggtaaaacaacttaattctgttttgcatcgcaaacttcagtgcattcttaccttcttgctctggactatttggtggaatatccagaacattcagataaaaaatgctttctttattagtgggcagtttattcggcataattttgatttttacttgctgcccggaatttgcccctatttttgccactggtggcgttaacatgaaaggaacctgaattttttctggtggtaatgacgtatcgccatcatcaatccacgcctgcagcagcgaagaacggtttccctggttcatcaactgcaccatcacttctttattttctgccgggtaaataatgcgcgtcccgtagataacaattccggcatgtgcaggaaggaccatagaaaaaatgagtaaagataataatcctttcattttaatgcctcttaaattaaaaggccgccatgggatagcggccatgtttattacctggagaaacttacaattttatttattaatcctgcgccacacgcataaccagagaagataacacatcacctgattgcactgagttatctgtcagtttcaggtattttgctttaaacggaatagcatattgaccttccgctgttttataactctcaatgttaaaaggtgcagaaacatccaggacatcgctgttatcacctaaatagagatagtaacccacggtatcgttgctactggctatcgccttatcgttaccggttattttatcgttggtaatcaacgagagttttacaccagcaacttctttcgggcagctaatttttaacatgctgctggttacaccgactgcatcatcataggtagaatatttagctttaccttcaaagacactggttggtacagtcggcatattaatacttactgaatcaccacccgcttcgaatttacacggagattctgcaatattccccttaatagttaatgttccggtatcaacgtctgcagcaaatactccagcgctcataaaaaaagaagaaaagacagcggcagcaataattgaacgtttcataatatgttccttaataaaatttatttttggttgttaagagtctgtatctcttggaaacaaatttctcacatcaaaaaagttgccgcaatgtaaacacattgttttattgatttaaaacaaattaaccattgcaatataaatacaaaaaatatttaagagtattaactatttatcgcatctatcaattaatgtagatttatgtaaatggtattgttgatatcaataaaaaagccgaaatcatttatataaatgatttcggctttctaaatgcaattaaaatcaggttgccaaattaatcgtagcgatttaacacgattcgacgtttgctatcgctacctgcaacaaccacttctgtcgttacacctttgacgggcgaagaaaacagatgacgggtgtcaacattatacgttaactgaccacaatgctgttgaggttgaccattaaccatagccatactgcatgttgggggactgatcctgccattaatcgctaatgtggcagtctctgaagagaatgcgggagaagccaatccataggcaagaaaaataattcctgacagccaatacttattcattgaacgttatccctgtagtaaaggttatgcctggatagaatgagtgcataacaaactatagctgtacatccactacacagccacgaaggatgataatgaagcattgcctgtatgatcaatcgactttgtagagtttcggacgaaggtccgcagaatattcgcagtattaaataagtgttcattaatgcggcaaaaactaatacaccgcatcaatgtaacatctctgcggtgtatgaagaataaccagaatggttaataggcgttagaccgcgcggaaggaaatctcgcctggaatgacttcaccctgccagtagagctgagctgcaacgcggtcagccagctggcggtagatagcggtaaattcgctctccggacggctgataaccgttggcgtacctttatcgagatcctcacgtaaggagatgtgtaacggcatctgccccagcagctgtgtatggtatttttcagccagtttctctgcaccaccggtaccgaaaatcggttcatggtgaccacagttactgcaaatatgcacactcatgttctcgacaataccgagcaccggaacctcgactttctcgaacatcacaatgccttttttcgcatcgatcagcgcgatgtcctgcggggtggtgaccacgactgcaccggttactggaatgttttgcgccagcgtcaattgaatgtcaccggtgcctggcggcatatcaagcaccagatagtcgagatccggccacaaggtttcctgcaacatctgcattaacgccttgctcgccatcggtccacgccacaccatcgcattgtcgtcagtgaccagataaccaattgaattggttgccaggccatgagacataatcggtgccatatgggtaccgtccggcgaagttggacgctgattttctgcgcccaacattgttgggattgatgggccgtagatatcggcgtccagaatgccgactttcgccccttctgccgccagcgccagtgccaggtttaccgccgtggacgatttacccacgccgcctttaccggaactcaccgcgataatgttcttcacaccgttaattcccggctgattcttcacgcgtttcagagtggctatgttatgcgacagtttccagtcgatagctttcgccccggtgatgcgcagcagttcggcgctacattgctcttttaactcttcgaacgcgctatgccagacaaacggcataaccagttccacatgcaacgtgtcgtccatccaggcgacatggtgcaacgctttcagcgtggtgaggttatgcttcagggttgggtgctgaaaattggccagtgtcccggcgaccattgcgcgcaaggcttctggtgatttggcctgggattgttcgttcatcccgactccttttttgtatagataaaccatcagctgatagtttacctgaagaatatagagaagtacttacttaacattttcccatttggtactatctaaccccttttcactattaagaagtaatgcctactatgactcaagtcgcgaagaaaattctggtgacgtgcgcactgccgtacgctaacggctcaatccacctcggccatatgctggagcacatccaggctgatgtctgggtccgttaccagcgaatgcgcggccacgaggtcaacttcatctgcgccgacgatgcccacggtacaccgatcatgctgaaagctcagcagcttggtatcaccccggagcagatgattggcgaaatgagtcaggagcatcagactgatttcgcaggctttaacatcagctatgacaactatcactcgacgcacagcgaagagaaccgccagttgtcagaacttatctactctcgcctgaaagaaaacggttttattaaaaaccgcaccatctctcagctgtacgatccggaaaaaggcatgttcctgccggaccgttttgtgaaaggcacctgcccgaaatgtaaatccccggatcaatacggcgataactgcgaagtctgcggcgcgacctacagcccgactgaactgatcgagccgaaatcggtggtttctggcgctacgccggtaatgcgtgattctgaacacttcttctttgatctgccctctttcagcgaaatgttgcaggcatggacccgcagcggtgcgttgcaggagcaggtggcaaataaaatgcaggagtggtttgaatctggcctgcaacagtgggatatctcccgcgacgccccttacttcggttttgaaattccgaacgcgccgggcaaatatttctacgtctggctggacgcaccgattggctacatgggttctttcaagaatctgtgcgacaagcgcggcgacagcgtaagcttcgatgaatactggaagaaagactccaccgccgagctgtaccacttcatcggtaaagatattgtttacttccacagcctgttctggcctgccatgctggaaggcagcaacttccgcaagccgtccaacctgtttgttcatggctatgtgacggtgaacggcgcaaagatgtccaagtctcgcggcacctttattaaagccagcacctggctgaatcattttgacgcagacagcctgcgttactactacactgcgaaactctcttcgcgcattgatgatatcgatctcaacctggaagatttcgttcagcgtgtgaatgccgatatcgttaacaaagtggttaacctggcctcccgtaatgcgggctttatcaacaagcgttttgacggcgtgctggcaagcgaactggctgacccgcagttgtacaaaaccttcactgatgccgctgaagtgattggtgaagcgtgggaaagccgtgaatttggtaaagccgtgcgcgaaatcatggcgctggctgatctggctaaccgctatgtcgatgaacaggctccgtgggtggtggcgaaacaggaaggccgcgatgccgacctgcaggcaatttgctcaatgggcatcaacctgttccgcgtgctgatgacttacctgaagccggtactgccgaaactgaccgagcgtgcagaagcattcctcaatacggaactgacctgggatggtatccagcaaccgctgctgggccacaaagtgaatccgttcaaggcgctgtataaccgcatcgatatgaggcaggttgaagcactggtggaagcctctaaagaagaagtaaaagccgctgccgcgccggtaactggcccgctggcagatgatccgattcaggaaaccatcacctttgacgacttcgctaaagttgacctgcgcgtggcgctgattgaaaacgcagagtttgttgaaggttctgacaaactgctgcgcctgacgctggatctcggcggtgaaaaacgcaatgtcttctccggtattcgttctgcttacccggatccgcaggcactgattggtcgtcacaccattatggtggctaacctggcaccacgtaaaatgcgcttcggtatctctgaaggcatggtgatggctgccggtcctggcgggaaagatattttcctgctaagcccggatgccggtgctaaaccgggtcatcaggtgaaataatcccccttcaaggcgctgcatcgacagcgccttttctttataaattcctaaagttgttttcttgcgattttgtctctctctaacccgcataaatactggtagcatctgcattcaactggataaaattacagggatgcagaatgagacactttatctatcaggacgaaaaatcacataaattcagggcagttgagcaacagggaaacgagttgcatatcagttggggaaaagttggcaccaaagggcaaagccagataaaaagtttttcagatgctgcggcagcggcaaaagcggagcttaagctgattgcggagaaggtgaagaaggggtatgtggagcaagcgaaggataattctttgcaaccttcccaaacggtaacgggctctctcaaggtagcggacttatccaccattattcaggaacaaccctctttcgtagcagaaacccgtgcgcctgacaaaaatacagatgctgttttaccgtggctggcgaaagatattgctgtcgtttttccgcccgaagttgtacacaccacgttaagtcatcgccgctttcccggagttcctgttcagcaagcagacaaattgccccaattacgtcgcttagcctgtagtgtgtcgcaacgggataataaaacagccacatttgacttcagcgcctgttctttagaatggcaaaacaccgtcgcccaggcgatcagtcagatcgacggcctgaaaacaacacagttaccatcaccagtaatggctgtactcacggcacttgaaatgaaatgcacaagatataaagtgcgtgaggatgttatggatcagatcgtccaggaaggcggtctggaatatgctactgatgtaataatacaccttcaacagattgatattgaatgggattatgcgaataatgtcattattattctgccgtctggcattgcacctagctacttggagcaatattccagatttgaatgacgcctacgtaaacatttatcactgacggaagagtctctctggcaaaaatgtgcacaaaaacttattgccgcaattccacatattccagaatggcggcaaccattaattgctttgttattacccgaaaaaccagaaattgcacatgaaattgcccagcgtctactggggcaaaaaaaattaccctcgcttgagtggttaaaaatagtggcgactgatgagcacattcttgcctcattagaaaaatatcacgaaccatatgccatttttgatgattactattgtggtgcgatatggtcagccaccgtattacaggagcaaggtgttgcagccctgccccgatttgctccctatgccgcaagtgactactgcgccgatgtgttgcgtcatatcaatcatccgttcgcattgacactgcttatacgtgtagccgggcaaactaaacgctgtcacgatcggatgacgaaagccattgctgcgttcccacatgcagcaatggcggcactgacggaacttcttgggcaaaaagaagagaacagttggcgcattatgctaatgacaatgcttatctcacaaccagcactggcagaacaggtcattccctggctctcgacacccgcagttgccgtactgaaatcatgccagcaacaactgacacagccctcaaaccatgccagcgccgatctactgccagccgtagtagtctcccctccctggctttcgaaaaagaaaaaatcgccgattccggtgctggatttagcgccattaggcattgagccaatctgttatctgacagaagaaatcagtaatcaacttttggcgaaatatatctggtattcaaaacacatcacggttagccatgaagaaagtactaccaacctgttggcaaggatgggttttcaacgacggatcgctggtacatatattaaagctcccgaagcggtagttgaggcatggctaaatgaagattattcaaccttactaagtgaatttaaggtgtttcattcacctaccgggcattattggcagttggggattttgacaacattgccgctggagaaagcagtaaaagcatggaatgcccttaccctatctccacataccgataccgaatactccatgttacattttggactcaaagggttacctgggttagtaaactcacttgcacgctatccacaagaagccttgcccatcacgaattacttcgcagcgagtgagctggctcctgccgtcgcccgtgccttcaacaaactgaaaacgctacgcgaaaacgcccgtagctggctgttgaaatacccggaacatgcccttaccggcctgctgcctgcggcgctcggcaaagccggtgaagcacaggataacgcccgcgctgccttgcgtatgcttaccgaaaacggtcatcagccattactgcaagaaatcgcccgacgttataaccagccggaagtaaccgatgcggtgaacgctctgcttgcgctcgatcccttagataatcacccgacaaaaatccccactcttccggccttttatcagccatcgctctggacgcgcccggtattaaaagcaaatgcccaatcactgccagatagcgccctcctccacctcggtgaaatgctccgcttccctcaggaagaggctctgtatccgggattattgcaggtgaaagacgtctgttccgccgactcactggcgggatttgcctgggatctgtttaccgcctggcagaccgctggcgcgccgtcgaaagagagttgggcgttcactgcgttaggcgttctcggtaacgatgacaccgcccgcaaactgacgccattaatacgcgcctggcctggtgaatcccagcataaacgcgccaccgttgggttggatattctcgctgctatcggtagtgatatcgcccttatgcagcttaacggcatcgcccagaaactgaaattcaaagcattacaggagcgggcaaaagaaaaaattgccgacattgccgagagccgcgaactcacggtggcggagcttgaagatcgggttagcaccggatctcggtctggatgataacggttcgctgctgctggattttggcccacggcagttcaccgtcagctttgatgaaaccttaaaaccgtttgtgcgtgatgtttccggcagccgcctgaaagacctgcccaaaccgaacaaaagcgatgatgaaacgcgggcgaacgatgcggttaaccgctacaaattgctgaaaaaagatgcgcgtaccatcgccgcccagcaggtagcaaggctggaatccgccatgtgcctgcgccgccgctggtcgctggaaaacttccagctcttcctggttgagcatccgctggttcgtcacttaacccgccgtctgatttggggcgtttatagcgccgaaaaccagctactggcttgctttcgcgtagcagaagataacagctccagcaccgctgacgatgatcttttcaccctgccggaaggcgatatctctatcggcactcctcacgttctggaaatatcaccaacggatgctgccgcctttggtcagctttttgccgactacgaactgctaccaccgttccgccagctcgaccgtaacagctacgccctgacagaagccgagcgcaatgccagtgaactgacccgctgggcaggcagaaaatgcccgagtggtcgggtcatggggctggcgaataaaggctggataaagggcgaaccacaggatggaggctggatcggatggatgatcaaacctttgggtcgctggtcgttaatcatggaaatcgatgaaggctttgcggtaggcatgtcgccagccgaactcagcgctgagcagctcttaagcaagctgtggctatgggaaggcaaagcagaaagatatggctgggggagtaattcaacacaggaagcgcagttctccgtaatcgatgccatcaccgccagcgagctaattaacgatattgaagccctgtttgaataaggaaagagcatggacaaggaattaccgtggctggcggataacgcccaactggaactgaaatataaaaaaggcaaaacgccgctcagtcatcgtcgctggccgggcgaaccagtgtccgttatcactggaagtctcatccagacattgggtgatgaattgctacaaaaagctgagaagaaaaaaaacattgtctggcgttatgagaatttttcactggagtggcagtccgccatcacgcaggccatcaacttgatcggcgaacacaaaccctcaatcccggcccggacaatggcggcgctagcctgtatcgcgcaaaatgacagccaacagttgctcgacgaaatcgtccaacaagaggggctggaatatgcgactgaggtggtgattgcacgccagtttattgcgcggtgttatgagagtgatcctctggtagtgacattgcagtatcaggacgaggattatggctatggttatcgctcagaaacctataacgaattcgatctccgactgcgtaagcatctctctctggcagaggaaagctgctggcagcgttgcgccgacaaactcattgccgcactaccaggaataaacaaagttcgccgcccttttattgcgctgatcctcccggaaaaaccagaaatagccaatgagttggtaggccttgaatgcccgcgaactcattttcattctaaggagtggttaaaagttgttgctaatgaccccacagcggtgagaaaactcgaacactactggagccaggatatatttagcgatcgagaagccagctacatgtcgcatgaaaaccacttcggctacgcggcctgcgccgcccttttgcgcgaacaaggactggcagccattccgcgcctcgcgatgtatgcccataaagaagattgcggcagtctgctggtacaaattaaccatccgcaagtcatccgcaccttgctactggtggctgataaaaacaaacccagcctgcaacgtgtagctaaataccataaaaacttcccccatgcgacgctcgccgcactggcagaactgctggcgttaacagaaccaccagcccgccctggttatccaatcatcgaagacaaaaagctgcctgcacagcaaaaagcacgcgatgaatactggcgtacgctgttacaaacgctgatggcatcgcagccacaactggcagcagaagtgatgccgtggttaagtactcaaccccagtcagtgctgaagagttatttatcggcaccgcccaaaccggttattgatggcaccgataacagcaatctgccagaaatcctcgtttcaccaccgtggcgtagtaagaaaaaaatgacagctccacgtcttgatttggcaccgctcgaattaactccgcaagtttactggcaaccaggcgaacaagagaggcttgccgccactgagcctgcccgttatttcagcacggaatctcttgcgcaacgcatggaacaaaaaagtggacgagttgtattacaggaactgggttttggggatgatgtatggctgtttctgaattatatactccccggaaaactggatgctgcacgcaattcactctttgttcagtggcattactaccaggggcgggttgaagagatcctgaatggctggaactccccggaagcacaattagcagaacaggcgctccgcagcggtcacatagaagcgttaattaacatatgggaaaatgacaactactcacattatcgtccggaaaagagtgtctggaacctgtatttattggcacagttgccgcgtgagatggctttgaccttctggctgcgtatcaatgagaaaaagcatctgttcgcgggtgaggactattttctcagtatcctcggattggatgcgctaccaggtctgctgttggctttttcacatcgtccaaaagaaacatttccgttaattttaaattttggcgcaacagaactggcgctgcctgttgcccacgtctggcgacgtttcgcggcgcagcgtgatctggctcgccagtggattttacaatggccggaacatacggctagtgcacttatccctcttgtctttaccaaacccagcgataatagcgaagccgcattacttgccctgcgtttactgtacgaacagggacatggcgaattgctacaaaccgtggcaaaccgctggcagcgtacagatgtatggtctgccctggagcagttgcttaaacagggtccaatggacatttacccggcacgcattccaaaagcccctgatttctggcatccgcaaatgtggtccaggccgcgccttatcactaataatcaaactgttaccaatgacgctctggaaattatcggcgaaatgctgcgctttacccaggggggacgtttttatagcgggctggaacaactgaaaacgttctgccagccacaaacgctggcagcttttgcctgggatctcttcactgcgtggcaacaagctggtgcccccgcaaaagacaactgggcatttctggcgttaagtctctttggtgacgaaagcacggcacgggatctgacgacacagatcctcgcctggccacaagaaggcaaatctgcccgtgctgtcagcggcctgaacatccttaccctgatgaataatgatatggcgctgatacagctgcatcatatatcgcaacgggctaaatcccgccccttacgtgataacgcggcggaatttcttcaggtggtcgcagaaaatcgcgggctaagccaggaagagctagcggacagattagtcccaaccctgggccttgatgatccgcaggcgttgagttttgattttggtccccggcagtttaccgttcgcttcgatgaaaatctcaacccggttatctttgatcagcaaaacgttcgccagaaaagcgttccccgtttgcgcgccgatgacgatcaactgaaagcgcccgaggcactggcccgactaaaagggctaaaaaaagatgctactcaggtgagcaaaaacctgctcccgcgtcttgaaacggccctacgtaccacccgacgctggtcgctggcagattttcattctctgtttgttaatcatccctttacccgtctggttacccagcgattaatatggggggtttatccggcaaatgaaccgcgttgtttactcaaagcctttcgtgtggccgcagagggggagttctgcaatgcgcaagatgagccaattgacctgcctgcggacgctctgattggcattgcccacccgttagaaatgacagcagaaatgcgcagtgaatttgcacagctttttgccgattacgaaattatgccgccttttcgccagttgtcgcgccgcacggtgctgctcacacctgacgagtcaaccagtaacagcctgactcgctgggaaggtaaatccgctaccgttgggcaacttatgggaatgcgatacaaaggctgggagtcaggctatgaggacgcatttgtctataacctgggtgagtaccggctggtccttaagttttcacccggttttaaccactacaatgttgatagcaaagcgctaatgagcttccgttctcttcgagtgtaccgtgacaataaatccgtcacttttgccgaacttgatgtgtttgatttgagtgaggcgttaagcgcacctgacgtcattttccattaaaacacagcgggcagtgatgcaactgcccgttatcaacacgacttaccagcggggaaagcgatgatcgtgcaaaaagagctggttgctatttacgattatgaggtccctgtacctgaagatccgttttccttcagacttgagatccataaatgctctgaattatttacaggttccgtctatcgactggagcgattccggctacgtccaacatttcatcaacgtgatcgagaagatgctgacccgctaataaatgatgcgttgatttatataagagatgagtgtattgatgagcggaaattacgaggtgaatcacctgaaactgtaatagcaatttttaatcgtgaactacagaatatattcaaccaagaaatagaataatatactctaaataattcaaattggtccgatccggcgcaacgtcccaatggcctggattataaatctcattatcttaattgcaacggggtccagccgtggttataattcgttcgttggaacacgatgttgcacaggctgtggtgttaggcctgaaaatagtaaataaaagaacctgcctcaccagcaggtttttttatttactgtgatctgctttccagatatttttcgctcaaacaactaatgcgccaaacatttattgcgcgtaaaatatcgtttatttcattaatacatttcagggatgaatatatgtcaccgcagaataatcatctgcagcgtccgcctgctgctgtgttatacgccgatgaactggcaaaattaaaacaaaatgataacgcaccttgcccgcccggttggcagttaagtttgcctgcggcccgtgcttttatccttggcgacgaagcgcaaaatatcagccgtaaagtggtgattagcccctccgctgtcgaacgtatgttagtcactcttgctaccggccgcggtttgatgttggtgggggaaccgggtaccgcaaaatctcttctttctgaattactggcaaccgctattagcggcgatgccgggttaaccatccagggcggggcatctaccaccgaagatcaaatcaagtatggctggaactacgccctgcttatcaatcatggtccgtcaacggaagcgctggtccctgccccgctttatcagggaatgcgcgacggcaaaatcgtccgtttcgaagagataacgcgtacaccgctggaagtgcaggactgtctgttaggtatgctttctgacagggtgatgacggggccggaactcactggtgaagccagtcagctctatgcgcgagaaggctttaatattattgccactgccaatacccgcgatcgcggcgtcaatgaaatgagtgctgcgctaaagcgtcgcttcgattttgaaacggtttttccgattatggatttcgcccaggagttggaactggtcgccagtgcttcggcgcgtttgctggcccatagcggtattccgcataaagtgcctgacgcggtactggaattactggtccgcaccttccgcgatctgcgtgccaacggcgaaaagaaaacgtcaatggatacactgacagcgattatgtccaccgctgaagccgtgaacgtggcccatgctgtgggcgtccgcgcctggtttttagcgaatcgcgcgggggagcctgccgacctggtggaatgtattgccggaaccatcgtcaaagataacgaagaagatcgcgcgcgtctgcgccgttacttcgaacagcgtgtcgccacacataaagaagctcactggcaggcttattatcaagcccgccaccgcctgccgtgaggaaagatgcatgagcgagccgttaattgtcggcatccggcatcatagtccggcctgcgcccggctggtgaaatcgttaatcgaaagccagcggccacgatacgtgttgattgaaggcccggctgattttaatgaccgggtagacgaactgtttttagcccaccagcttccggtagctatttacagttattgccagtatcaggacggtgcagcccccgggcgtggtgcctggacgccatttgctgaattttcgccggagtggcaggcgctacaagccgcacgtcgcattcaggcacaaacttacttcatcgatttgccttgctgggcgcagagtgaagaagaggacgattcgcctgatacgcaagatgaaagccaggccttactgctgcgtgccacccgcatggataacagcgataccctgtgggatcacttgttcgaagatgaaagccagcaaactgcattaccctctgcgctggcgcactattttgcccaactgcggggcgacgcctccggcgatgcgctcaatcgtcagcgcgaagcctttatggcccgctggattggatgggcgatgcagcaaaataatggcgacgtgttagttgtctgcggtggctggcacgctccggcactggcaaagatgtggcgcgaatgccctcagaaaattaacaagccagaattgccctcgctggcagatgccgttacaggttgttatctcacaccctacagtgaaaagcgccttgatgtgctggcaggatacctttcaggaatgcctgccccggtatggcaaaactggtgctggcagtggggcttgcagaaggccggtgaacaactgctaaaaactatccttacccgtttgcgccagcacaaattgcccgcttctaccgcggatatggctgccgctcatctgcatgcgatggcgctggcacagttgcgcggtcatacactaccgttacgcactgactggctggatgccatagcaggctcgctgattaaagaagccctgaacgcgccgttgccgtggagctatcgcggcgttattcatcccgataccgatccgattctgctaacgttgatagacacattagcgggtgacggattcggtaaacttgccccttctacgccacaaccgcctctgccaaaagatgtcacctgcgaactggaacgtaccgcaatctcccttccggcggagcttaccttaaatcgctttacccccgatgggctggcgcaaagtcaggtgttacatcggctggcaatactggagatccctgggattgtacgccagcagggaagtacactgacacttgcaggcaacggtgaagaacgctggaaattaacccgcccgcttagccagcatgcggcattgattgaggccgcctgttttggtgccacactccaggaagccgcacgcaataaattagaagccgatatgctggacgcgggcggaatcggcagtatcaccacatgtcttagccaggcggcgttagcgggtctggcgtccttcagtcaacaattactggagcaactcacactattaatcgcccaggaaaatcaatttgccgaaatgggccaggcgctggaagtgctttatgccttatggcggctggatgaaattagcggtatgcaaggcgcgcagatattacaaacgacgttatgcgcgactatcgatcgcacgctgtggctgtgtgaatctaacggcagaccggatgaaaaggagtttcacgctcacctgcatagctggcaagcgctttgccatattctgcgcgatctacatagcggcgttaatttacccggcgtttctctttctgcggcggtagccttactggagcgacgcagtcaggcaattcatgccccggcgctggatcgcggcgcggctcttggcgcactaatgcgtctggaacatcccaacgccagtgccgaagcggcgctgacgatgctggcgcagttatccccggcacaatctggtgaggcgctgcacggtttgctggcgctggcccgccatcaactggcctgtcagccggcatttatcgccggtttcagcagtcatttaaatcaactgagtgaagccgattttattaacgccctgcccgatttacgcgcggcgatggcctggctaccaccacgagaacgcgggacgctggcgcatcaggtgcttgagcattatcaactggcgcaacttcccgtttcggcgctgcaaatgccgttgcattgtccaccacaggccattgcacatcatcaacaactcgaacagcaggcactggcatcgctgcaaaactggggagttttccatgtctgaactgaacgatcttctgaccacccgtgagctacaacgctggcgattaattcttggcgaagcggcagaaacgacgctttgtgggctggatgacaacgcccggcagatagaccacgcgctggagtggctgtatgggcgcgatcctgaacggctccagcgtggtgaacgttccggtggattaggtggctcaaatctcaccacccctgagtggatcaacagtattcacacgctgtttccgcagcaggtgattgagcggctggaaagcgatgccgtgctgcgctacggcattgaagatgtggtgacgaatctcgacgtgctggaacgtatgcagccttctgaaagcctgctacgcgctgttttgcacaccaaacatctgatgaaccccgaagtactggctgccgcccgccggatagtgtgccaggttgttgaagaaattatggctcgactggcaaaggaagttcgtcaggctttttctggtgtccgcgatcgccgtcgccgttcatttattccactggcgcgaaactttgatttcaaaagtactctgcgcgccaacctgcaacactggcacccgcaacacggcaagttgtatatcgaatccccccgctttaacagccgcattaaacgccaaagcgaacaatggcaactggtcttactggttgatcaaagcggatcgatggtcgattcggtgatccactctgcggtgatggcggcctgtttgtggcagttacccggcattcgtacccatctggtggcgtttgacacaagcgtcgttgatctcacggcagacgttgccgatccggtagagttattaatgaaagtacagttgggcggcgggaccaatatcgccagtgccgtggagtatggtcggcaacttattgaacaaccagcgaaaagcgtcattatcctcgtgagcgatttttacgaagggggttcatcatcattactgacgcatcaggtgaaaaagtgtgtccagagcggcatcaaagtgctgggactggcagcgctcgatagcaccgcaacaccttgctatgaccgcgatacggcccaggcgctggttaatgtcggcgcacaaatagccgccatgacgccgggcgagctggcatcatggcttgcggagaatcttcagtcatgaattcactacgtccggaattattagaactgacaccgcaggccctgacggcgttaagcaatgccggttttgttaagcgcagtcttaaggaactggaaaatggcaacgtcccggagatcagccatgagaacgacgctttaatcgccaccttcagtgacggtgtccgtacccagctggcgaacggccaggcactgaaagaggctcagtgcagttgcggggccaacggtatgtgccgtcatcgcgtgatgctggtgttaagttatcaacgactttgtgccaccactcagtctacggaaaaagaagaagagtgggatccggcaatctggctggaagaactggctacccttcccgatgctacccgcaaacgcgcacaggcgctggtcgctaaaggcatcaccattgagttgttctgtgcgccgggtgaaattccctctgcccgcttaccgatgagcgatgtgcgtttttattcccgcagcagtattcgtttcgcccgttgtgattgtattgaaggcacactttgcgaacatgtcgtactggcggtacaggccttcgtcgaggccaaagcgcagcaagcagaatttaaccatttaatctggcagatgcgcagcgaacacgtcacatcatctgacgatccgtttgccagcgaagaaggcaacgcgtgtcgtcaatatgttcagcaattaagccagacattatggcttggcggcatcagccagccgctcatccattacgaggcagcattcaaccgcgcattgcaggcggcagagacctgcaactggcgctgggtgagtgaatcgctacggcaactgcgcgccagcgttgatgccttccacgcccgcgccagccactataatgccggagaatgcttacatcagcttgcggcattaaacagtcgattaaattgcgcacaagagatggcccggcgcgacagtattggtgaagttcctcctgtgccgtggcgcacggtcgttggctctggcattgccggagaagcaaagcttgatcatctgcggctggtgtctttaggtatgcgttgctggcaggatattgagcattatggtttacgcatctggtttaccgatcccgacaccggcagtattttgcacctttcgcgcagttggccgcgaagtgaacaggaaaactcaccggcagctacgcgtcggctgtttagttttcaggctggcgcactggcgggcgggcaaattgtttcacaagcagcaaaacgcagtgccgatggcgagctgctgttagctacccgcaaccgcttaagcagcgttgtgccgctgtcgcctgatgcctggcaaatgttgagcgcgccgttacgccagccgggcattgtggctttgcgggaatatttacgccagcgtccccccgcctgcatacggcctcttaatcaggtcgataacttatttattctgccggtcgctgagtgtatttcgctcggttgggacagcagccgccagacgctggatgcgcaggtcattagcggcgaaggggaagataatgtgctgacgttatcattaccagcctcagccagcgcaccttatgccgttgaacgcatggcggcgcttttgcaacaaacagacgaccccgtgtgtctggtttctggctttgtcagttttgttgaagggcaattgacactggaaccacgggtgatgatgacaaaaacccgtgcctgggcgctggacgcagaaactacgcctgtggcaccgctaccttctgccagcgttttgcctgtgccgtctactgctcatcagttgctgatacgctgccaggcgttacttattcaactgctccataacggctggcgctatcaggaacagagtgctattggtcaggcatagttgctggcgaatgacctcaccgcggtgggtttttatcggctggcacatgtgttgggacaatttcgtaatacagaaagcgaggcacgggtagaagcaatgaataacggtgttttgctttgcgaacaattattccccatgcttcagcaacaaggatgaaatagtgctttttactaagagttctactccagttccggactgctcacgccacggtattaggcatatcctatatagcccctggtgagagtcaccagttccttgattaaataaaatggagttttacatgaaggctttcaataagctgttttccctcgttgttgcatctgttctggttttctctcttgctggctgcggtgacaaagaagaatcgaagaaattcagcgccaatctgaacggcactgaaattgccattacctatgtctacaaaggtgacaaggtgcttaagcaatcttctgaaaccaaaattcaatttgcctccattggtgcaaccaccaaagaagatgctgccaagacacttgagccgttaagcgccaaatacaaaaacatcgcgggtgttgaagaaaaattaacctataccgatacctacgcgcaggaaaacgtgactatcgatatggaaaaagtggattttaaagccctgcagggtatttcaggaatcaacgtttctgctgaagatgccaaaaaaggtatcactatggcgcaaatggaactggtgatgaaagccgctggttttaaagaagtgaaataatcggttggcggtcatgctctaaacatgaccgccaattttttagccttttttcacatgctggcgcgctgccagtccacgcagaaaataacgtaaaaattgatcgccgcattcgcggaagtttttatgatccggtgcgcgcatcatcgctgtaatttccggcatcgaaacgcggaactgctgttcggtgaggatagccagaatgtcatcggttttcagcgaaaacgcgatgcgtaattttttcagcacgatgttgttattaatgcgacgttccggctccagtgccggagcagactcatccttgccgcgtttttcataaatcaggccattgaggaatgacgacaaaacaatgtccggacaacgctgaaaaccctcttcgtcttctttacgtagccagacggcgatctgttccgcggtggcttcgacattacccagcgccagaatacgcaccaggtcattattattggctttcaaaatgtagcgcacgctgcgcagaatatcgttacttagcatgaggccttcaggtgttgatgaggcaaaaagccattttagcagtcttttacaggccaatcgcctcttttaagcttttcagataacggcggctgaccggcacggttaagccattacgcaaaatcaactcggcctggccgttatcttccagacgaatctcctgtaaatgcgcgaggttaaccagatactgacgatggcagcgcagtagtggtgtacgactttccagggtacgtaatgtcaattcggtaaagccctctttcccttcgtggctggtaacgtagacaccgctcatccgactgctgacaaatgccacatctttcatttgcagcaaataaatccgactatgccccgtacaagggataaatttcagcgcctgttgattttccggtaacagcgaaacatcctgcttgctgcgctcctgacgcaatcgcgccagcgttttctccagtcgcgcttcatcaattggcttcagcagataatcaaaggcatgttcttcaaaggctttaattgcgtattcgtcaaacgcagtgagaaaaacaatatacgggcgatgttccgggtcaagcatccccaccatttccagaccactgatgcgcggcatctggatatcgagaaacagcacatccgggcgcagtttatgcaccgcgccgatcccttccacggcgtttgaacactctccaacgatttcaatatcgctctgctcctgcaaaaatacacgcaggttctcccgtgctaacggttcatcatcgacaattaagactttaatcatgcctcgtccctccatggtagtcgtaacgttattcgggtgtaactatcaggctcacaggcgacgcttattccatagtcatcgccaaaccgttcacgtaaacgcttatccaccagattcatccccagcccactggcattggttaccggttgatacaaaccggcattgtcttcgatctccagcatcaaatgttgcccctcacgtcgggcgctgattgccactcgccctgtatccagcagttgtgatgtcccatgtttaatggcgttttccactatcggttgcagggtaaacgcgggcaattgctgctgggataattcttgcggaatagcaatgttgacctgcaaccgcgactggaagcgcgccttttcaatttgcagataagcattcacatgttcaatttcgtcggcgagagtaacaaactccgaaggccgctttaagtttttgcggaaaaaagtggaaagatactgcaccagctggctggcctgttcgctgtcgcggcggatcaccgctttaatggtgttaagcgcattaaacaaaaaatggggattcacctgggcgtgaagcagtttgatctctgactgggtgagcatcgctttttgccgctcatattgcccggcaaggatctgcgccgaaagcaattgcgcaatcccctcacccaacgtgcggttgattgaactgaataaacggtttttggcttcatacaatttgatggtgcccatcacccgctgattttcaccacgcaacggaattaccagcgtcgaccccagtttgcattgcggatgcaaagagcaacggtaaggtacttcgttgccatcagcgtagaccacttcaccggtttcaatcgcttttaaagtataagttgaagaaatcggtttgccgggtaaatggtggtcgtcaccaattccggtaaaggccagcaatttctctcgatcggtaatcgcgactgcaccaatatccagttcctgatacagcacctgagccactttcatgctgttcacttcgttaaacccctggcgcaaaatgccttccgtcgaggctgccactttcagcgcagtggcagaaaaagccgaagtgtatttttcaaacatcgcgcgtttatcgagcaatatacgcataaacagcgccgcgccgacggtattggtgaccatcattggcgcagcaatattactcaccagacgcaccgcatcttcataaggtcgggcgatcgcaaggatgatcagcatttgcaccatttcagcgacgaacgtgacggcaccggcggtaatggggttaaagactttatcagtgcgcccgcggcggatcaggatgctgtgtaccaggccaccgagtaatccttcaacgatggtcgagatcatgcaacttaacgcggtcatgccccccatcgaatatcgatgtaagccgccggtcagcccaaccagcccaccgacgaccggaccgccgagtaagccgcccattaccgcgcctatcgcacgggtattggcaatagaatcgtcaatgtgcaacccaaaccaggtgcccatgatgcagaagatggaaaagacgatgtagcagagaaatttatgcggcagacgaaccgtgacctgcattaacggtatgaataatggcgttttactcattaaccatgcaatgactaaaaaaacgcacatctgctgaagcagcagcaacaccagattaaaatcgtacatacccgcaaaccacacttccctttaaaacgcgtaacatacattgcctgcgtttaactttctttgaactcttgcagaaaaatgagaattcgtgagtacgatcactcaaaatcgcctggcaaaaataaaatcaccctatagatgcacaaaaaacgggcaaaactacctggttcgcaaaactgcgtctaaagttaaaccgggacctcgcgagcaagggtgagacgatggcgctttacacaattggtgaagtggcgttgctttgtgatattaatcctgtcacgttacgcgcgtggcagaggcgttacggattgctgaaaccgcaacggacagacggcggtcatcggctgttcaacgatgccgatattgaccggatccgcgagatcaaacgctggatcgacaacggcgtgcaggtcagcaaagttaaaatgctgctcagtaatgaaaatgttgatgtgcagaacggctggcgcgatcagcaagaaacattactgacttacctgcaaagcggcaatctacatagcctgcgaacgtggatcaaagagcgcggtcaggattaccccgcccagacactcaccacacatctgtttattcctctgcgccgacggcttcagtgccaacaaccgactctccaggcgctgctggcgatcctcgacggcgtactgatcaactacatcgccatttgtctggcttcggcacgtaaaaaacagggtaaagatgcgctggtggttggctggaatattcaggataccacccgtctgtggctggagggctggattgccagtcaacaaggatggcgcattgatgtcctcgcccactcgctcaatcaactacgccctgaactattcgaaggccgtacattgctggtgtggtgcggtgaaaatcgaacctccgcccaacagcagcaactcaccagttggcaagaacaaggccatgatattttcccactcggcatttaatgattcgttaacaaatgcgctttactgtacaatcctttcgttaacataaggagtgcattatgcgcatagctaaaattggggtcatcgccctgttcctgtttatggcgttaggcggaattggtggcgtcatgctcgcaggttatacctttattttgcgtgctggctaagcgcctgcaccagcctttcaaacaggcggtctgcgatgatcgccgccagtgccaccagtaacgccccctggatcacatacgcggtattaaatccgctaagcccgatgatgatgggcgtacccagcgtgctggcccctaccgttgaggcgatcgtcgccgtaccaatgttgataatcaccgaagttcgcacgcccgccagaatcaccggagccgccagcggtagctcgaccttacgcactcgctgaccacgactcattcccatacctttcgcaacttctgtcacgctggcatcaatcgctcccagcccggcaagtgtcgcctgcaggacgggcagcacaccgtaaaggatcaaggcgataatcgctggttgcagaccaaagccgatcaccggaacggcgatcgccagcactgcgacgggcggaaaagtctgtccaacggcggcaatagtttccaccagtgggcgaaattccgcgccccacgggcgagtgacagcaattccggcaccagtgccaatgatcaccgcaaacaaactcgaaattcccaccagccagaaatgagccagtgccagagctgcaaaactttcttgctgataaacgggtcgtggcagttgtgggaacaaggcagcaaacagcggctggctgtaaggcagccagaaaatcagcgccacaaacagagcaatgagccagaacagcggatcgcgcaacatcttcatacgcttacgcctccaccagcagatcctgaaaatgcagcgtgccgcaaggctggccctgcatgttcaccaccggcagcacctcgcatccccgcgcaacaaacagagagagcgcatcgcgtagcgtcatctcttctgccagtgcctcaccatctgctcgttcttcgcgacgcacgtaatccgccacactacgtaacgaaagcaggcgcacacccagttcactacgtccaaaaaactggcggacaaaatcattcgccggacgagtcagcatcgtcagcggattgccctgctgcactacttcaccgtgatccatcaataccagatgttctgccagccgtagcgcctcatcaatatcatgagtgaccagcacaatggtacgccccagcaaacggtgaatgcgcgtcatctcttgttgcaacgcgccgcgcgttaccgggtccagtgcgccaaaaggttcatccattagtaagacttgcggatcggcagccagtgcacgcgccactcccacacgttgctgctgaccaccggaaagctgatgcggataacgctcacgcaaatttgactccagccccagtagcgccattaattcgtcgatacgatcgtcaatccgcgcccgcgaccatttttgtaattgcggcacggtagcgatgttttgcgccacgctccagtgggggaacaggccaatagattgaatggcatagcccatccggcggcgcaactccagtactggcagcgagcgaatttcttctccggcaaagcggatctctccgctgtcatgctccaccaggcggttaatcattttcagggtggtggatttgccggagccagatgtgccaatcagcaccgaaaaactcccttcctgaaaattgagattgagatcgttaacggctttttgtgcgccgaacagtttgctgacatggctaaattcaatcattacgtttcaccttcagcagtgcgataagcaaatcgaacagcgcgtcggtaagcaccgccagaacaattaccgggatcacccccagcaacactaaatcaatggcgctgcttagcagcccctggaaaaccagcgcaccaaaaccgcctgcgccgattaacgccgcaatcaccgccatacctacagtttgcaccatcaccacccgcaggctgcgcagaaataccggtaacgccagcggtaactgaacatgcaggaaacgctgcgccccgctcatccccatcgctctggcgctttccagcacatcgcgcgggatctggttcaaaccgactaccacgccgcgcaccagcggcagcaaggcatagagcaccagcgcaatcagtgcgggtgtcattccggttcctgctatgccgagcgtccccagccacggaaaggccgtaaccagcgcggcaagcggcgcaatcaacaggccaaagagcgccaccgaaggcacggtctgaatcacattgagcagagaaaaaattgccccctgccgagcagtggaaaagtagcaccagatgcccaacggcacaccaatcactaacgcaggcagcaccgcaccaaacagcaacgtcagatgttgtgccagcgcgtcgtcaaacacatcctgacggttggcgtattctttcattagtgagagatcgttaagcgtgccggagtacagcaaccacagcggaataatggcaatctgcatatgcaacaaccagcgccacagcggatgcgtggagattcggcggatggcatcgctacaggccagcaatgccagcgccgcagccagccagaaaccactgccgaggctggtacgcgccagcgcactgccattttgcgccagttgggtcgccgcctttccagctccccacaccagcaatacgaagacgaattgcgccagaatgagtgcacaaatgctgccttttttaccgggaataaaacaggccgtcagccaggcgcaaccaacgcccaccagcatccagatcgtttgcggccacagctgccagagatgacgcccctcacccgaaactaaacgattaggcgcgtaactgataaacggcagcgccgctgcgattgccgtcagcaacagcagcagcgccagaacaggattaatacggaaataagtcacgggaaattacttcgtccaccctttttgtttcaggtagtcggcagccacttttttggcatccagtccttccacagcaatgctggcattcagttgctgcaatgtttttgcatcgaggctggcgaagactggctgtagccactgtgccatttgcggatactccctcaacaccgactcacgcaccactggtgcaggcgcgtagataggttgcacaccttgcggatcgcttaaggtttgcagccccagcgccgctaccgggccgtcagtgccgtaagccattgcagcattaacgccagaggtttgctgggcagcggctttgatcgtcaccgccgtgtcgccaccagccagtgacagcaactgatcctgaccgagcttaaagccataggctttttcaaacgcgggtaacgcatcggcgcgttcgataaactctgccgaggctgccagtttgaaggtgccgccctcttgcagataacgactcaggtcggcaagcgaagtgagtttatttttctctgccacatcctgacgcacggcgatagtccaggtgttatttgcaggcgcgggcgtcagccagattaacttgttgtgctccgaatcgagctttttgactttctcgtaaccttgctgcgcgtttttccacgctgcatcgttttcatctttaaagaagaaagcgccattgccggtatattccggatagatatccagttcaccggaagtaatcgccccgcgcaccacaggagtcgttccgagttgcactttattcaccgtcggtacgccgtggctttccagcacctgcaaaatgatattgccgagtagcgcaccttcggtatcgatttttgaaccgactttaacgggggaagccgcctgtagcggcaggctcacggctgccaacataaccagtgaacctgcccagagctttaagagtggcatgatgctttcctcattcttttactgttgttttcagcgaattaagagaaaagcatagttgataatggcggggttagcttgagcggaaggattcagttgcagaatcagataaatacttaagaggcatattcggtccggcgtttcctgccggatgcggcgcgagcgccttatccggcctacaaagggcgcaaacgtcgcgcccttactaaagcattacagcaactcaaactcgcctttcttaacgcgtgcggaatcagtgccgataaagacattgaacttgccaggctcggcgtcatatttcatctgttgattccagaacttcagcgcctcaatatcgatcgggaagctgacagtctgagtttcgcccggtttcagggtgattttctcaaagcctttcagctgtttcacagggcgactcatggaagccgtcacatcctgcaagtacatctgcactaccgtggcaccctcgcgcttaccggtgttcgtcacctgcacgctggcagtcactttgccgtcacgcttcatggtcggcgcagaaagtttcacatcagagacggtgaaagtggtgtagctcagcccatagccgaacggatacaacgccccgttagcttcatcaaaataacgcgaagtgtatttgttcggcttgtcggcattatacgggcgaccggtattcagatggctgtagtacaccgggatctgcccgacagaacgcgggaaggacattggcagcttgccggacgggttgtaatcgccaaacaatacatcggcaattgcattaccgccttcagtccccgcaaaccaggtttccagaatcgcatcagcctgctgatcttctttcaccagcgccagcggacgcccgttcatcagcaccagcaccagcggtttaccggtggctttcagcgccgcaatcaagtcacgttggctttgcggaatagtgatatcggtccggctggaggcttcgtgcgccatcccctgtgcttcaccgactacagccaccaccacatcagattgtttcgccgtctgcaccgcttcatcaatcatctcttgcggcgaacgcggatcgactttgaccgcttcttcatactgattcaggaaatcgataatgcctttgtcactggtaacgttcgcccctttggcatacagcactttaccgttttcaccgacggcatttttaatcccggtcagtacggtcacggattgatcggcaacaccggctgcggaccagctgcccatcacgtcacgtttactgtccgccagtggcccaaccaccgcaatggtggccgattttttcagcggtaacgtttcgagacggtttttcagcaacaccaagctttcgcgcgccacttcacgcgcttctttacggtgcaggcggctttcggcattggtatccaccgggtcagactctttcggccccaaatggctgtatgggtcgttaaacaaccccatatcatatttaacgttcagtacatggcgggcagcatcgtccagctctgccatcgtcactttgccggatttaatcaacccaggcagatacttcgagtagtactcgtcgctcatgctcatgttgattccggatttcagcgccacgcgcaccgcatcttccgggtctgccgccgtgccatgtttaatcagctctttgattgcaccgtgatcggaaacggtgatgcctttaaagccccactggtcgcgcagaacatctttcagcagccaggaatcggaggtggctggcgtgccgttcagcgagttcagcgccaccatcaccgcgccgctgcctgcgtccagccccgctttgtacggcggcatataatcattaaacaggcgctgcggactcatatcgacggtgttgtactctttaccgccttctaccgcgccgtatgcggcaaagtgtttgacgctggtcatcaccgagtagcgatctgccgggcttttaccctgcatcgcttccaccatggttttacccattgttgaggtgagatacgtatcttcgccaaaaccttcggaagcacgtccccagcgcggatcgcgcgagacatcgaccatcggtgcccaggtcatattcaggccatcatctgccgcttcataagcagagacacgtccgaccgttttcactgcatcgaggttaaaagacgaggccagaccgaggctaatcgggaacaccgtgcgctgaccgtgcagcacgtcgtaagcaaagaaaagaggaattttcaggcggcttaattccatcacctgatcctgcatggcgcggatatcctgacgggttacggtgttgaaaatcgccccaacctgaccgtctttgatcatctcgcggatcgcctctttcgggttatccgggccgacgctgattaagcgcagctgaccaattttctcatcaactgtcattttcttaagcagttcggtgacgaacgcatcccgcgcttcgggcgttaatggatggttgccgaataaatcatccgccagtgctggctgcagggccagactcaccgcgattcctactgaacatagccatttcatatggatttttcttcctttgttgcccgacgtggcagcgaaaatggtgcaaaaaccgtagtttgccataagcatgatggagagagaaaaagaatgctcagtttattgtctgaattttcaaaatattcactcgctgaattgttatacaaggcgctattctagtttgtgatattttttcgccaccacaaggagtggaaaatgtcttccatgacaacaactgataataaagcctttttgaatgaacttgctcgtctggtgggttcttcacacctgctcaccgatcccgcaaaaacggcccgctatcgcaagggcttccgttctggtcagggcgacgcgctggctgtcgttttccctggctcactactagaattgtggcgggtgctgaaagcctgcgtcaccgccgacaaaattattctgatgcaggccgccaatacaggcctgaccgaaggatcgacgccaaacggtaacgattatgatcgcgatgtcgttatcatcagcaccctgcgtctcgacaagctgcacgttcttggcaagggcgaacaggtgctggcctatccgggcaccacgctctattcgctggaaaaagccctcaaaccgctgggacgcgaaccgcactcagtgattggatcatcgtgtataggcgcatcggtcatcggcggtatttgtaacaactccggcggctcgctggtgcaacgtggcccggcgtataccgaaatgtcgttattcgcgcgtataaatgaagacggcaaactgacgctggtgaaccatctggggattgatctgggcgaaacgccggagcagatccttagcaagctggatgatgatcgcatcaaagatgacgatgtgcgtcacgatggtcgtcacgcccacgattatgactatgtccaccgcgttcgtgatattgaagccgacacgcccgcacgttataacgccgatcctgatcggttatttgaatcttctggttgcgccgggaagctggcggtctttgcagtacgtcttgataccttcgaagcggaaaaaaatcagcaggtgttttatatcggcaccaaccagccggaagtgctgaccgaaatccgccgtcatattctggctaacttcgaaaatctgccggttgccggggaatatatgcaccgggatatctacgatattgcggaaaaatacggcaaagacaccttcctgatgattgataagttaggcaccgacaagatgccgttcttctttaatctcaagggacgcaccgatgcgatgctggagaaagtgaaattcttccgtccgcattttactgaccgtgcgatgcaaaaattcggtcacctgttccccagccatttaccgccgcgcatgaaaaactggcgcgataaatacgagcatcatctgctgttaaaaatggcgggcgatggcgtgggcgaagccaaatcgtggctggtggattatttcaaacaggccgaaggcgatttctttgtctgtacgccggaggaaggcagcaaagcgtttttacaccgtttcgccgctgcgggcgcagcaattcgttatcaggcggtgcattccgatgaagtcgaagacattctggcgttggatatcgctctgcggcgtaacgacaccgagtggtatgagcatttaccgccggagatcgacagccagctggtgcacaagctctattacggccattttatgtgctatgtcttccatcaggattacatagtgaaaaaaggcgtggatgtgcatgcgttaaaagaacagatgctggaactgctacagcagcgcggcgcgcagtaccctgccgagcataacgtcggtcatttgtataaagcaccggagacgttgcagaagttctatcgcgagaacgatccgaccaacagcatgaatccggggatcggtaaaaccagtaaacggaaaaactggcaggaagtggagtaaaaattacggatggcagagtatcgccatccgaattcacttaatcgttctgtgccgtctgccccgccgccgccatttgggcggctttttgttttttatagctcaacgctgctgccggcacaggcatcactttaccggtttcaatccaggtacgcaggcggctggcatcggcaaaatgggtatatttgccaaacgcgtccatcactaccagcgccaccggtttattattgataaccgtacgcatcaccagacaatggcccgccgcattggtaaagccggttttggttaactgaatattccagttatcgcgatacaccagatgattagtattgcggaacggcagcgtatacgtcggattagagaaggttgccatatcttcccgggtagtacttaactgcccgatcaacggatattgtttgctggcaatgagcagtttggttaagtcacgggcagttgaaacgttatgcaccgacaatccggtaggttcaacaaagcgcgtgttgttcattccgagcgatttcgctttcgcattcattgccttaataaaggctttgtaaccaccgggataatggtgcgcaaggcttgccgccgcgcggttttctgaagacatcagcgccagcaacagcatatctttacggctgatttcgctattcagtcgtacgcgcgaatagacccctttcatctccggcgtctggctgatatccacttttagtttttcatccagcggcagtcgtgcatccagcacaaccatcgcggtcattaatttgctgatagacgcaatcggacgcaccagatccgggtggttcgaatagatcactttgttggtattcagatcaacaatcatcgcgctaccggaggcaatttccggttgtgaagcggtggtagcggctgccgttttcgcaacggcctgcggtgcaaaaggcacagccagcatcagggccaggctaaataaagaaactcgaaatttcggcatgatgagcattcagatagtggttcacgcgcacgggttgcgcaccgccggagtaaggatttactgaggctagcgacgccatcataacgagcaaaaagtgcgatcgtcaaaggagaatcgtgaggaaatgctgcattgctgacatttacgccagcaatgcaacgtcaaagaactttctagaacaaacgataaccgtagccccatagtataacggttagggcgagcagcacttccagtaccagcacgccaatcgccagcgtcgaactagagaagctaaggccttcctctttgttgatattcaggaagctcggaataccaaggtaaagcaggtagccggtgtaaaacagcgccaccgtgccgaccagcgcacacaaccagaccagtggataaagcgccaccagaccgcttaaaaacagcggagttgcaacgtagcccgcgaagaccatgcagtgcgcaagtgacggacgctgcggataattacgcgccatccaccagatgacccgccccatcaccgcgaccccagccagcataacgccgtaaaacaagacagccagcgccagtccggtaaaccaggataacttcaggatagtgccatcgccaaaattccagccaatctgtgtagtgccaatgaaggcgcaaatcaccggaatcgccgccatcagcaaaacgtggtgggtgtaatggtgagaaatcgtttcgttttcgcgattaatcacctgcatttcacgatcgggatgggaaaacagtccccagacatggctcataccgcccccttgttgtgagttcatgaacctgacagttcaagtataagtcagcttgtgattattttttgttcgcccatgtaattttcactgtctgatgaacgtcctttttcagcgtgaatgattcacagggtgtatgcttactggcaaccaaagggagacagactggcctatggatctcaatacacttatctcacaatatggttatgccgcgctggtgatcggtagcctggcggaaggtgaaaccgtgactttgctgggaggcgttgcggcgcatcaggggctattaaagttcccgctggtggtactttctgtggcgcttggcggcatgattggcgaccaggtgctctatctgtgcgggcggcggtttggcggcaagctgttacgccgtttctcgaaacatcaggataaaattgagcgggcgcagaaacttatccaacgccatccgtatctgtttgtcattggtacgcgctttatgtatggctttcgggtgattggcccgacgctgattggtgccagccagctgccgccgaaaatctttctgccgctgaatattctcggcgcatttgcctgggcgttgatttttaccactattggttacgctggtggtcaggtgattgcgccgtggttgcacaatctcgaccagcatttgaagcactgggtctggttgattctggtcgtggttctggtggtgggcgtgcgctggtggctgaaacgacgcgggaagaaaaagccggatcatcaggcgtaaaaccattgccctggataaggcgttcgcgccgcatccgacatccggagtaccatgcctgatacgacgcttgtgcgtcttttcatgccgaccaaaatattacccaatgaaatatccacgcacctcactgcgctattctgggttgaactgtggattcgccaacataaagccgccatccactatcaacgactgcccggtggtgtaatttgcgccctccgaacaaagccacaccaccaggctggcaatctcatgcgttgcgccaaaacgccgcaagggaatcgaaggctccgcgtcgggcttcacgtcgctgtcatccatgccattcattggcgtggcgatcgccccaggcgcgactgcgttcaccaaaatcttatgcctgaccagctccagcgccatcgctttggttaacccaccgagcgcatgtttagcggctgtgtaggcgctggcatccggcagcggcgtatgttcatgtaccgacgtaatgttgatgatgcgaccgccctgcccttgtttcaccatctgacgagccgcaatttgcgagcataagaatgcaccatcgacatcaacggtaaaaatcttgcgccactcatcaaaagccatatcaagaaacggcgctttggtcattgcacccgcattattcaccagcacatcaatgcgccccagccgttgaatgagtttctccagcgccagtgccccttctggtagattgccgagatccagctgcacgatctccgcacgtacgccgtggctaactacctcacgcgcggtatcttttgccccttcttcatctgagtgccaggtaataccaatatcaaacccctgctgcgccagtaataacgcgcactctttgccgatccccgaatcggaggcggtaataatcgcaacctgtgccatcgagttctccacttaacgctgaataaacgttaagtatagaaggcgcatatcatcagcgtttgtaccccccgcccaacgcaccagtgagttgaatggaggcatccagccactgcccttgcaataacaggccattggcccgctcacgcagcgcggggattctggcttcgctgacgcgggaaccagcaatgatgcccgcgttaaagcgcgcctgcgcaagacctaccacacgcaaggcatcgcgctcaatttgcgcctgatgctggtttttctccgccagtgtctgaacctgactggctgcccgcgccacgtcattcaccgcttcaaccaccgctttgttgtagctggcgatagacaagttgctttcggcttttgcgatatcgagattggcgttaagacgaccactatcgaaaatgggtagcgtcaggcctgccgtaacgcccatttgctgcgcggaatgacggaacagatcgcttaagtgcaacgcatcctgttgcaggaaggccatcaggttgatgtcaggataaaatgccgcttttgccgcatcaatggtgcttagcgatgactcaacgtaccagtgcgccgcctgcaaatctgcccgccgggccagtaaggagtaccccagttcatcaggaagctggcttgccactttcggcaacgcgaccggtttaagcttcaatgactttgtctggttatttgtaagtgcgcttaaccgtgcctcaataattttcattttccccgcgacatcgttgagctgctgccgggttttgctggcattaatatcggtttccacaccttcaactgaagaagtaatcccgttctgatatagctggcgatcggtcgcgataatggtgttctgctctttttctatttgctgcaagaccgtgtttaacgccgcctgggtttgccactcccagtacaggcgggctacgctgccagccagcaattggcgggtttgctcgcgttccgccgcccgtgctttaaccgtacccaggcgggcagtaacctccgcccgattctttccccagatatcgagatgccagcccgccgttaagccaaaagtaccgttggtgtaccacgggccggtcgtacctgcggccggatcgttcagagcaaacggccccattaagccttctgccgacattttttgccgctccatatccgccgaaaagtcgatctgcggaccatcctgagtggcaactgccttcgcctgggcttcagctagctgaatgcgctgttcagccacctgcatatccggtgcgttctgtagtgcattgttaattaaggaagtgagttgattatcgtgatactccagccaccattggctgtctggccaaccattttcagcgccgtgggtaatgcggtgtcaacttgtgcagcgggcgtttgctggcttaacgcctggcgggtttcatgcataggcgcacacccggccagcatcagtaacagcggaaaacaggcgatggctggataaaaggaatcacgattcatgggggaataatcaggtaagaaaaggtgcgcggagattaccgtgtgttgcgatatattttttagtttcgcgtggcaatacatcagtggcaataaaacgacatatccagaaaaatatacactaagtgaatgatatcttccgatttatcttaatcgtttatggataacggcaaagggcttcgttttttcctatacttattcagcactcacaaataaaggaacgccaatgaaaattatactctgggctgtattgattattttcctgattgggctactggtggtgactggcgtatttaagatgatattttaaaattaattaatgtcatcaggtccgaaaataacgagaatatttcagtctctcatcctgttgcgctcctgtcatgtgcattgcttcatataatcactggcgcaaggagcgcgcagggggcggccaatcgccgccgccccctgcacccccgggctctggcgaacaaaatcgccgctgcgcggtgccctcggcttatcccttacggctaccgggtcgggcgcgaggtaacatccctgtaaaacgcgccctcagcccacatccatgtgggctgccccggccttcagggaacgcctcggcaattttgacgccaccaaacaaccgtgcggcctattgataaagagctaacacattgtcaaaaaacatcactatggttttttagagtttctcgatatcaattgcctgaatagcccttgcaatatcaggggaattattcaacacccgaacatgctgaaataattccgttgcttcatcgtattctttacgcaaataactcaaccactgtttaatccgcgcaacgtgatataacccggtatcgccctgcttttccagacgggtatatttttgcagcaaagcaaccacctccggccacggcattcgcggttcgttatattttaccacccggctcaggttgggaatattgagcgccccgcgaccaatcatcactgcgtcgcagccgctgatcgccatgcattgttgcgcgctctgccagtcccagatttcaccgttggcaatcaccggaatattcagccgctggcgaatatcgccaatcgcctgccagtcaatatgctccgcgcggtaaccctgctctttcgtccgcccatgcaccaccagctccgtagcgccagcctgttgaaccgcatcggcgatttcaaatttcttctcaccgctgtcccagcccagacgcactttcacgctgacgggcaaatgcgccggtacagcttcacgcatcgcttttgcaccctggtagatgagttcaggatctttgagtaacgtcgccccgccgccgctaccgttaaccgttttcgacgggcagccgcaattgagatccacgccccaggaacctaactccaccgcacgggcggcgttctctgccagccattgtgggaactgacctaacaactgcacgcgcaccagcgtaccagatggtgtccggctggcgttttgtagctcagggcaaatgcgatgaaagacttttaccggcagcagttgatccaccacgcggacaaactcggtgatgcacagatcgtagtcgttaacttcggtcagcaattcacgcaccagagagtcaagcactccctccatcggtgccagtaacacacgcatatcatcacccgcaaaaaaatgaggcgctatgttagcgcctatggtcagcggattaaaggtctgcaaagagggattgctgcaaactgcaatccctctctatgcttgatgtatgcctgagttcgctgcgcattgcgtaatgccggggagcgaaaaaataagcgctgatttcttaatgtgatcggtagcacgttttacgaattaattgtatgatgaatccatctcatctggggtgttgattatgagtaagacactgaacattatctggcaatatttacgcgctttcgtcctgatttatgcctgcctgtatgcaggcattttcattgcttccctgctaccggtaaccattccgggcagcatcatcgggatgctgatcctgtttgtcctgctggccttgcaaattcttccggcaaaatgggtcaatccggggtgctacgtactgattcgctatatggcgctattgtttgtgccgattggcgtaggcgtcatgcaatattttgatttgctccgcgcacagtttggcccggtagtggtttcctgtgcagtcagtacgctggtggtttttctggtggtgagctggagttcgcaactggtacacggtgaacgtaaagtcgtaggtcagaaaggatcagaagaatgatggcgaatatctggtggtcattaccgctgacattgattgtcttttttgccgcccgcaaactggcggcacggtataagtttcccttgcttaacccgttgctggtagcaatggtggtgatcattccttttttaatgctgactggcatctcttacgacagctactttaaaggtagcgaagtgctaaacgatctgctgcaaccggcggtcgtcgcgctggcctatcctttatatgagcagctacaccagatccgcgcgcgctggaaatcgatcatcaccatctgttttatcggcagcgtggttgcgatggtgacggggacttccgtggcattgttgatgggcgcttcaccggaaatcgccgcgtcaatcctgccgaaatcagtcaccacgcctattgcaatggcggttggcggcagtattggcggtattccggcaatcagcgcagtttgcgtgattttcgtcggcatcctcggcgcggtatttggccatacattgcttaatgcgatgcgtattcgtaccaaagctgcgcgcggtctggcaatggggactgcctcgcacgccctcggtacggcgcgctgcgccgagctggattatcaggaaggtgcatttagttcgctagcgctggtgttatgcgggataattacttcgctgatcgcaccgttccttttcccgattattctggcagtaatgggctaaaatttgcgatgcgtcgcgcatttttgatgtatgtttcacgcgttgcataattaatgagattcagatcacatataaagccacaacgggttcgtaaactgttatcccattacatgattatgaggcaacgccatgcatccacgttttcaaaccgcttttgcccaacttgcggataacttgcaatctgcactggaacctattctggcagacaagtacttccccgctttgttgaccggggagcaagtctcatcgctgaagagcgcaacggggctggacgaagacgcgctggcattcgcactacttccgctggcggcggcctgtgcgcgtacgccattgtcgaattttaatgttggcgcaattgcgcgcggtgtgagcggaacctggtatttcggtgccaatatggaatttattggtgcgacaatgcagcaaaccgttcatgccgaacaaagcgcgatcagccacgcctggttgagtggtgaaaaagcgcttgcagccatcaccgttaactacacgccttgtggtcactgccgtcagtttatgaatgaactgaacagcggtctggatctgcgtattcatctgccgggccgcgaggcacacgcgctgcgtgactatctgccagatgcctttgggccgaaagatctggagattaaaacgctgctgatggacgaacaggatcacggctatgcgctgacgggtgatgcgctttctcaggcagcgattgcggcggcaaaccgttcgcacatgccttacagtaagtcgccaagcggtgtcgcgctggaatgtaaagacggtcgtattttcagtggcagctacgctgaaaacgccgcattcaacccgactctgccaccgttgcagggagcgttaattctgttgaatctcaagggttatgattacccggatatccagcgcgcggttctggcagaaaaagccgatgcgccgttgattcagtgggatgccacctccgcaacgctgaaagctctcggctgtcacagtatcgaccgagtgcttctcgcttaagcctggtgccggatgcggcgtgaacgccttgtccggcttgccagccctctcctggtgtcgaaattcccggcaaacagtttgccgtttcttgcgcaaaaccagcgggtaaagtagcctgatggaaattttccttagatcgagtctcctgcatgttaaagcgcgtgttcctcagcctgttagtcctgatcggcttgctgctgttgactgtgctcggcctcgatcgctggatgagctggaaaaccgcgccttatatctacgacgaattgcaggatctcccctaccgccaggtcggtgtggtgctcggaacagcaaaatattatcgtactggcgtaattaatcagtattatcgctaccgcattcaaggagcgattaatgcctataacagcggtaaggtaaattatctattactgagcggcgataacgcattgcaaagttataatgagccgatgaccatgcgcaaagatttaatcgctgctggtgtcgacccatcagatattgttctcgattacgcaggctttcgtacgctggattccatcgtgcgtacacgcaaagttttcgatactaatgatttcattattatcacccaacgtttccactgtgagcgagcattatttattgcgctgcatatggggattcaggctcagtgttatgccgtaccgtcaccgaaagatatgctgtcagtacgtattcgtgaatttgccgcccgtttcggtgcgctggctgacctttatatttttaaacgtgaaccgcgttttttagggccgctggtccctattccggctatgcaccaggtaccggaagatgcgcaggggtatcccgccgtcacacccgaacagttacttgaattacaaaagaaacaaggaaagtagttatggatgtacagcagttttttgtcgttgccgtttttttccttatcccgatattttgtttccgcgaagcatggaaaggctggcgcgcaggcgcgattgataaacgggttaaaaatgcaccggaaccggtgtatgtctggcgagcaaaaaatcccggactctttttcgcttatatggtggcatatatcggcttcggaattttatctatcggcatgattgtttatcttattttctatcgttaatattcccctctccagttaattattgagaataattattacttcacctgataagctgcggatatcacattcctaaccgcagctatttgtgaatcttttcacagtttaaattcccccgcacgcttagccttaatatcagtacattattatttactaaacgctcgccttaattacctatagcattaaggaagatcacatgccgcaacaaaattatctggatgaactcactccggcttttacgtctttactggcgattaaagaagcctctcgctgtttattatgtcacgacgctccctgtagtcaggcttgcccggcacagaccgatccggggaaatttattcgctcaatctactttcgtaattttaaaggcgctgccgagacaattcgcgaaaataatgccctcggtgccgtttgtgccagagtgtgcccgacggagaaattatgccaaagcggttgtacccgtgccggtgttgatgctcccattgatatcggccgcttacagcgttttgttactgattttgaacaacaaaccggaatggaaatttatcagcccggtactaaaacgctcggcaaagtcgcgattattggcgcaggtcctgccggattgcaggccagtgtgacactgacaaaccagggttatgacgtcacgatttatgagaaagaagcgcaccccggtggctggttgcgtaacggtattccgcaattccggttaccgcaatcagtgctggatgcagagatcgcccgtattgaaaaaatgggcgtgaccattaagtgcaacaacgaagtcggtaacacactcacccttgagcagctgaaagcagaaaaccgcgcggtactggtcaccgtggggttatcaagcggttccgggctaccgctgtttgagcatagtgacgttgagattgccgtcgacttcttgcaacgtgcacgacaggcgcaaggcgatatcagcattccacaaagcgcattaattatcggcggcggtgatgtcgcgatggacgtagccagcacgctgaaagttctcggctgtcaggcggtaacttgcgtagcgcgtgaagagttagatgagtttccggcaagcgaaaaagagtttaccagcgcccgggagctgggcgtttcgatcatcgatggattcacgccagtagccgtggaaggcaataaagtcacgtttaagcatgtacggttatcgggcgaactgacgatggcggcagataaaattattctcgccgtcggtcagcatgccagactagatgcctttgcggagttagagccgcagcgtaacaccatcaaaacacaaaattaccagacccgcgacccgcaagtctttgctgctggcgatattgttgagggtgacaaaaccgtggtctatgccgtgaaaaccgggaaagaagccgccgaggcgattcatcactatttagagggagcttgctcatgttaacgaaagatctttcgattactttttgcggcgtgaagtttcccaacccgttctgcctctcttcttcgccggtaggcaactgctatgagatgtgtgccaaagcctacgacacaggttggggcggtgtggtgtttaaaacgatcggcttttttatcgccaacgaagtctcgccgcgttttgatcatctggtgaaagaagataccggttttatcggcttcaaaaatatggagcagattgctgaacatccgttggaagagaatctggccgccctgcgtcggctgaaggaagattacccggacaaagtattgatcgcttcgatcatgggggaaaatgagcagcaatgggaggagctggcgcgcctggtgcaagaagctggcgcggatatgatcgagtgtaacttctcctgtccgcaaatgacttctcatgcgatgggtagcgatgtcgggcaaagcccggagctggtagaaaaatattgtcgggcagtgaaacggggttccacgctgccaatgctggcgaagatgacgccgaatatcggtgatatgtgcgaagtggcgctggcggcgaagcgcggcggcgcagatggcattgcggcgattaacaccgttaaatccatcaccaatatcgatcttaatcagaaaatcggtatgccgatcgttaacggaaaatcgagtatttccggatattccggtaaagcggtaaaaccgatcgccctgcgcttcattcagcaaatgcgcacccatccagaactgcgcgatttcccaatcagcggtatcggcggcattgaaacctgggaggatgcggctgagtttttattgctcggcgcagcaacgttacaggtgaccaccggcatcatgcagtacgggtatcggatagtggaagatatggcaagcgggttgtcgcattatctcgccgatcagggatttgattcgctgcaggagatggtaggtctggcgaataacaatattgtcccggcggaagatttagaccgcagttatattgtctatccccgtatcaatcttgataaatgtgttggctgtggacgctgttatatttcctgttacgacggcggtcaccaggcgatggaatggagcgagaaaacccgcacaccgcattgtaataccgagaaatgtgtgggttgtctgctttgtggtcacgtctgcccggtgggttgtattgagctcggggaagtgaagtttaagaaaggcgagaaagaacacccggtaacgttgtaaaaccagagacgcatccggcatttggttcctgtcgccggatgcggcttgaacgccttatccggcctacaaaaccatacaaatcagtatgttgagcttattgtaggccggataaaacgcgccagcgttgcatccggcatttggctcctgttgccggatgcggcgtgaacgccttatccggcctacaaaaccacacagatcatgatgttatgtgcgtttatgaccgaatgcggaccacattcacatcatttcttacgcgcgtatttcagtgaatccagcgctacggcgaagataataatcgcccctttgatgatgtactgccagtatgggtttacgccgatatacgtcaggccatagttgatgacggtaaaaataattaccccggtcaccacgccaatcaccgtccccacaccgccgctgaacgatacaccgcctaccacgcacgccgcgatagcatccagctcatacataaagccgaggttgttggtggcagagccgatacgtccggcttctaacatcccgccaaaggcatagaacacgccagacaacgcgtagatcatcagcaggttcaggccgacgttgacaccagatacttttgccgcttccgggttaccgccaatggcaaaaatgttcttaccgaagcgggttttgttccacaacacccagacgaacgccaccgcaatcaacgcgtagaaggtgatgtaagagagacggaaactccccagcgcgacaaagccctgagcaaaggtagagaagccactgtcaaaaccagaaattggcgacgccccgacaaagtcgtaatagagcgagttgatgccatagacgatgatcatcgtgccgagcgtggtaatgaacggcgtcacgttgagataagcgataatcagaccgttgatcaaaccgatcaccgcaccaatggcacagacaatcagaataaccagcgcaatcggcatcgtcgccatttccgggaacactttgttggcgttatccatggactgcaataatgtcgcagccaccactgccgccagccctacctgacgaccagcagaaagatcggtcccctgggtgacaattaaccctgccacaccgagcgcgataataatacgcaccgatgactgggtgagaatattacttaagttcaacagacttaaaaatgttgggtcctggaaaataataatcgccagcaaaactaaaagaacgacgtaaataccgccctctttcaggtaagtaagaaaacttttcttatttaacgcactcatgggaagcccctaatcttaaaggtgcaaagacgcaagacgcagaatttcgttttgcgttgttgtttttgtatcgacaattccggaaacgagaccattgctcatgaccagaatacggtctgttatccctaacaactcaggcatttcagaggagataataataatccccttgcctttcttcgccagttcggcaattaactgataaatttcaaacttcgccccgacatcaataccgcgcgtcggttcatcgagcattaatatttctggttgcgttagtagccagcgaccaataatcaccttttgctgattaccaccggagagcgaaccaatttgcgtccgatgacccggcgtttttacccgcatcgaatcaatcacccactgggtatcgcttttcatccgcgagttatccagtaaaccaactttatttttgtagttgcgaatattggaaattaacgagttaaaaccaatatccagataggcataaattcccgttgagcggcgctcctcagttaccagtgcaaatccatggtttatggcttcgttggcattatggttattgatctgtttgccgtgcaacgttatggtgccagccgatttctcgcgaataccaaataacgtctcaacaatatcggtacgtttcgcccccaccagaccggcaataccgaggatctcccctttatgcagatcaaacgagacatcgcgaatcgacggctggcgcagtgacgtcaggttacgtacctcgaggatgacttcgcccggtttgttttctttgtcagggaaacgctggttaagagaacgcccaaccatcatggcgatgatcttgtccatcgtcagtcctgccagcggttcggtggcgatccactgaccgtcgcgcaatacggtaacttcatcacataactggaagatttcttccattttatgcgagatataaacaataccgcagccgcgctcttttaatttacgaataatagtgaacagatgattgacctctttttcggttaacgaagaagtcggttcatccataatcacaattttcgcgttataggaaaacgctttggcgatttcgatcatctgcatttgcgaaacggataatgtgccgacgcgcgcacgcggatcgatatcaatatccagttcgtcaaaaatcgctttggtttcgcggtacattttgtcctgatcgacaaacatgcctttggtgggatatcgccccagccacatgttatccatcaccgaacgttgtaataccaggtttaactcctggtgtaccatcgaaataccattttccagggcttcttttgcagaatggaaatcgatctctttaccctggaataaaatggtgccggagtctttttgataaataccaaacaggcattttaataatgtcgattttcctgcaccgttttcccccattaatgcatggatagaatgtggccggacttttaaattaacgttatcaagtgccttaacaccaggaaaggacttgttgataccgctcatttccaacaagtattccccggaggacggagtcgttgagctgaccatataattttaccttgttggccatacaataagggcgcagtaatagactgcgcccaatcagtcttatttcttgctgaattcagccaggttgtctttatctacgccaacataaggtacgcggaccactttgttgtcgattttccagttggtgccatcagccgcacctttaccatcggccaggtttttcgccagatcaaaggtcgctttcgcctggttgttagcatcgttcagtacggtgcccgccagtgcaccggatttcaccagcgccagcgcttctggcagcgcatcgacgccaaacaccggaatgctggacttgttgtgtgctttcagcgcttcaaccgcgcccattgccatcgcatcgttgttggcgataaccacttcgattttgttggcgttcgggccagacagccaggcgtccatcttatctttcgcctgagcggtgtcccacattgcggtatctaactgtaactgttcagttttgatgcctttatcgttcaattctttaatcacgtaagtggtacgtgcttctgcatccggatggcccggttcacctttcagcagtacgaactgaatctgaccgtctttgttcagatcccaaccctgattcgccgcccagtgtttagcaatcaaatcgccttgaataatgccggactctttggagtcagtgccaacgtagtaggctttgtcgtagctatccagcgccttacgagacggttctttgttgaagaaaaccaccggcacgttttgcccacgcgctttctcaatcaccgtacccgcagctgccgggtcaaccaggttgattgccagtgccttcacccctttcgccagcaatacgtcgatctgatcgttctgcttggactggtcattctgagaatcattcatcagcagctgaacatctggcgcggctttcgcatcttgctcaatagccttgcgcactacagacataaagttatcgtcgtacttatagattgttacaccaatgcgagtatcagcagcgtgtgcagcggcaccgaataacatgctggccatcacagcagacagggttaacaccttcttattcatggtatctccggtttttcttatgcagggtagtgcttgagataaatgctcggcggggcagtagagttaatgaagtgttactgaacgccgaagctcactttttaaaattcgttcttccatgcccggtaacgctccagaaaacggctttaattgttgttatgacgctgttacctcggcaaaagtgattattcactgttacatacgggttacaacgttaaaacggtgcaatcatagctatcacattgttaagatactgtgaaatcactcacagattgaaagcggttacatcgcctgatttgttgagttagtgatcgccgccgcattctggcgtgttgcgacagaatggcgacgcactaacgtcggcataaaacagtggctggcacgaggatcaatattgcctgctgccccctgcaaggccagttcggtggctaatttcgccattgaagcaatgggataacgcacggtcgttaattgcgggtcggtgtaacgggcgatgggaatatcatcgaaaccgatgattgagagatgtaacggaatcgcaatgccattatcttttaatgctgtcagtgcgccagcggccatattgtcgttataagcaaatacagcggtaagttgtagattgcgccccagcagttcaaccatcgccgcctcaccgcccggcatgtccggcgtaccagcgccaatccagctttccggcggaataatatcctgctctttcaacgcactcatccagcctgctttacgcatggcgtcatcttcaatgccgtggctggaagaaagataaccaatacgttgatgaccgttattcagcaacatgcgcgtcgccattcgggcaccgctgagattatccaggcaaacgcaacgatgggcgtaccccggcacaacgcggttgattaacaccataccgggaatgttatccataaattgcgccagttcatcgtcactcaatgcttttgagtgaacaatcaacgcattacaacgctggcgaattaacacctcaatggcgtgacgctctttttccgcttcatgatagctattgccgattagcacgtatttctgatgctgctgagcgaccagatccaccgcttttaccagcgcgccgaaaaacgcatcagaaacgtccatcaccaccacgccaatggtgtcgctaacctgagttgccagcgcctgggcattggcgtttggccgataatccagctcactcacggctttcattactgcttcacgcgtgtcggcactgaccagcgtgctgttattgagcacccgggaaaccgttgccacagagacgccagcctgacgcgctacatcacgaatggtgatcatattcactacctgttatgagattgcagtaaatgactgcttgctggcggctattttgtcagcactgaatacaggacttcgtgaatcgagtcacagcaatggaaacggttacagccgttttgttaacgaatgtgatccagatcgttatcttgatgttttagatattgccggtccggcagcacgcaaagttaactgacgccagagccattccaccggcccctggcggaagtaacgcagccagataacagagaagaggatattcgccagccataccggaataacaaacgccagcagctccaggcggtcaaaatgcataaacaaaccgaggtggtaaaaaagcgtggtacaaatcagcgtttgcaatagatagttggtcagcgccatccgtccgacgcaggcgatcgcaagcaccagcttaaagcggctcaattgcggccagaagccataaaacagcgacgcatagccaatcgcctgaaacggcgcactcagttcccgcggcatttgaagtaagaaggcacaccagcgatacgcccagtccagctgccattgcagggcgatggcaggaaggttaatggtcaccccaatcgccaccagcacaaaaccagtacgacgatagtgacgtaagctgaactgccctttcagccagccgctgcgcatcagcgccgcaccaatgagcatcatccctgccagttgccagccatactgtgcgcccagtgccagtaaactgttgccaacaccatcggcacgattactgatcgcttcaacgccgccgtgaagcttccagtatttttcatacaaaatagccgatgcatccggcgtccaggcgcggctggtctggctgtcggaaatcagccccaataacagcaaaacgccaagccccaccagataaagcatgacgcctgtattaaacaggctttttaccgatggcgcatcgcgcaccagccgccagcagattaagcccaccagcccgtaagccagcaaaatatcgccgtcccagaacaataaaccgtgaataaagcccaacaagactaacagcgttaaccgcgactggatccagcgtctgccacggggcagcaacatttgcaggcccgcaccaaacagtagcgcaaaaagcgtgaggaatttcacctggccgatgagatcaagaaatgcccaagtccatgcatcccgcggcgtaatagcaccgtaccaggcgggattgagataagccgcctttggtagcccaaaggcgctgatgtttaatagcaggatccccagaatggcgacgccgcgaacaaaatcgagcgtgacgttgcgctccatggttcctgccttttaatcagttgtgatgacgcacagcgcgcagaaactcgtggcgcgtattctgactggatttgaacaatccaccaagagaggtcgttgtcgtggcactggttgcatcgcggatgccacgcgccttcacgcagtaatgcaccgcgtcgatcgagacagccacgttattggtgcccagcagcgtttgtagcgcaataagaatttgctgcgtcagacgttcctgcacctgcggacgctgggcaaagaactgcacaatgcggttaatttttgacagaccgatcaccgaatctttcgggatataggccaccgtcgctttgccatcgatggtaacaaaatggtgttcacaggtgctggtcagagtgatatcgcgcacggtgaccatttcatcgaccttcattttgttttcaatgagggtgattttcgggaaattggcgtaatccagaccggagaaaatttcatcgacatacattttagcgatgcgatgcggcgtttccatcaaactgtcatcagccaggtcgagattcagcagctgcatgatttcggtcatatgaccagcaataaggcttttgcgcgtttcgttatccatttcatgcacgggcgggcgcagcggtgtttccagtcctcgcgcaactaacgcttcatgaaccagggccgcttctttactgagtgatggcatttatgatttctcctgcaggtgtgacgcctccgccctgcgtgggggcaaagttattaagctgatttacagcctgattattgtgcgtgaggcggcgcacataatccagtattcacagcgataattattgtaattgccgctgcctttcatcagcagatgttaaaacatcgttatgcaaatacggaagtgaaagttactcacagcacattgaataaacggtatgatgaagaaattgcaaacaacacaacaaggagccacgcatggaaatgctcgaagagcaccgctgttttgaaggctggcagcaacgctggcgacacgactccagtaccttaaactgcccgatgacgttcagtatctttctccctccacctcgtgatcacactccgccaccagtgctgtactggctttccggattaacctgcaatgacgagaacttcaccaccaaggcgggtgcccagcgggtagcggcggaactggggattgtactggtgatgccagacaccagcccgcgcggcgaaaaggttgccaacgacgatggctacgatttaggccagggcgcaggcttttatcttaatgccacgcaaccgccgtgggcgacgcattaccggatgtatgattatctgcgcgatgaattaccggcgctggttcagtcgcaatttaatgtcagcgaccgctgcgccattagcggtcactcaatgggtggtcacggtgcgctgattatggcgctgaaaaatccgggtaaatacaccagcgtttcggcctttgcgccaattgtgaatccgtgcagcgtcccgtggggaatcaaagcgtttagcagctatttaggtgaggacaaaaatgcatggctggaatgggacagttgcgcactgatgtatgccagtaacgcgcaggatgcgatcccgacgcttatcgatcagggcgataatgatcagtttcttgccgaccagttgcaacctgcggtactggcagaagccgcgcgccagaaagcgtggccgatgacgctgcgtattcagccgggatatgatcacagttactacttcatcgcctcttttatagaggatcacctgcgcttccatgcgcagtatttactgaagtgaaagtccgcccggttcgccgggcatcttctcatcagaagcgataatccactgccataaagtaacgacgtccgtcttcgttatagctgtagtcgtcacgactgagatccttgtcgccaaggttcagcacgcctgcgcgcagtttgacgtctttagtcacctgccaggccgcgccggtattccagatggtataaccgcccggtgttttagccgtcgcgctgtcggcgcgtttctgcccggtatagtgcccagaaacatagaatgaccagtcttccagcgccagcggtttccagtccagcgtaccgttagcagtatggaacggcagatcggatagcggtttgttttcgccgttgctgacatcacgaccatcgttgtaggtgtagttgatcgacagtttccattcatcgttgaacggaattttcagttcggtttccacgccctgaatacgagctttgttaacgttgtagtagctaaataccggtatgcgccgtccgttagcgcccgtctcaaaaccaacaaagttttggtagcccggtgcagcgttgacgtcagacgtacggctgatgctgatacgatctttcacatcgttacggaaaacggtaacgctggattcaaccccttccagccagccttcttcacccatgtagtaaagccccagctcccaactttcgctggtttctggtttcagatccgggctacccacaatcttacatgcgccacggcaggaattgctcgtccagtcagggctaagttgcaacagagaaggtgctttaaatgccgtcgcccagccccctttcaccgttacggtgtcggtggcgttataaaccaggtaggcacgcggactccagtgttcaccgtaggtttcgtgatcgtccatacgcacgccggtcgtcagcgccagcggctcgaagatccgccattcatcttccacaaacagcgcgtactggctggcagacgttttggagctggttcccccggtcaggttcaccgcatcgctaagtttgtcgtgacgccattcaccgccaaccgtgagaaactgattaatcgccgtcagcggcaacgtgtatttgccgtcgaccgtattgctttcggaagttatcgggctgctgttgccagggtttttgttctcgactttctcaccgtagtatttcagttcgctggtgccgtaatcccaacgcccattatggctgacggagtagttctggcgttccaggcggtttttgtccagcgagtcggaatcacgatcctgacggtcgaaaccgtatccggcagtaaaatcgtgattttgattcggtgtccaggcaaattcgacattgccgtcgcggctggagaatccttcaatacgcggcgtttctccggtatcggtggtcgttgagttttgcgggtcatccttttcacgttttgccaggctgccgtaagctttcattcccagcacaccatcaattaatggtccactggtaaagaactgaccgttataggtgtcaccgcgatcgcgatgttcctgaatggtggtatcgacggtaacggtacccgaccatttctgaccgatttttttggtgatgatattcactacaccgccgagcgcatcggaaccgtacagcgacgacatcgggccacggaccacttcaatacgttcgatggaatcgaccgggatccagttcagatcgaaatcattgtggcggaagacggcattgcgggagttcacgcgtttaccgtcgacgagaatcagggtatagctgctgtccagaccacgaatactaacgcccttacggttatccccttcgttcgtcagttgtacgccaggcacttctttgaggacatccttcagattctgtaccggttttcgctgcaggtcttcctgggtaatgacgctgatactggcaggtgcatctttaagattttgttccacggaagatgcagtgacaaccatcgtttcgccatcatcatcgaccgctaacacaggccatgcacaagaaatagcggacaaacacagcccgacccgtacgaaagggttcaacctaaacattccatatctccatgaggtaactacgaaaataaaatgggttatcgctcacatcttcttcacgtccccttgcgtacggcagcatcgcggtggacttattttttatgcaggtgatcatcccagaaagccggaacagcctctgatttgtcagccttttttgattgcggcgtaacgataatgcaaacgataacaattatcaatccaaatgttaaattttatatccgcatgatttgtcagggaaatggaattgaaaaagccctctcggttgagagggcttagcaaggaagggaggaaacttatttcttatcgttctgcgggaacttcatttcgctgtagcgtacgaagtgagttcctttaatcagcttgtagccgaaccaaataatcaggaacagcgggataccaatatacgttgccgctacgccgccccagtcaatagtatctttcaggaacgcttcgtagttctggcccaaagtgataatcagacacagaatgaatgcgaagatcggccccagtgggaagaaacctgaacggtacggcagatcgttaatgtcgtgtccctgcaatacgtaaccgcgacggaagcgatagtggctaatggcaatccccagccaggcgataaaacccgtcatcccggaggtgttcagcagccacaggtataccgtctggttgccaaacatggaggtcaggaagcacagaccggcaatcaccgtcgtcgcatacagcgcattacgcggcacgccaccacgcgacagtttagcgaaaatgcgcggcgctttaccgtcacacgccagggtgtacagcatacgagtagacgcatacataccggagttacccgctgacagcaccgccgtcagaataactgcgttcatcaccgccgccgcagagagcagacccgcgtgctggaacaccagggtgaacggactaacgctgatgtctttaacatcgttacgcagcaggctcggatcggtgtacggaataatcaggctgataatcaggatcgcgaacacatagaacaacaggattcgccagaacacctgacgtaccgcgcgtggaatgtttttcgccggatcttcggactcgcctgcagcaataccgatcagctcggttccctggaaagagaagccgacaatcatagctacgccgatcatcgccgcaaaaccaccagcaaacggcgcttcgccgattgtccagttgctccagcccgcaggctgcgcgcctttgaagataccgataatcatcagcacgccaacgatgataaagacaataactgtcgtgactttgatcagtgagaaccagtattccgcttcaccaaagccacgaactgagatgtagttcagcaggaagataacgccgaggaacaacgcactccagatccagcccggtgtatccgggaaccaccagctcatgaccagctgagctgcaaccaggtcaacggcgatagtcaccgcccagttgtaccagtagttccagcccagcgcgaagccaaagccttcttcaacatagttctgaccgtaagtggcaaacgaaccggaaaccggcatatatgcagccagttcaccgagactggtcatcaggaagtaaaccatcaggccaatcagcatatacgagagcaatgccccgcccggacctgcctgagaaatcgttgcgccagaggcaacaaaaagacctgtaccgatggaaccgccaatggcaatcatcgtcaggtgacgcgcctttaattcacggcgtaagcccggcgcttctgtggttttagtttcggaaaccatacaaaaatgctatccatcttaaaaatgaggcgcgattgtagcagacgattggcaatccttccggcagaaatacacggttataagacaccttcatgatcgcccagggattataagtaaagcagccaatctcttttctggcgaatgcatgctgaaggcgctgcgtcacgaaatcgacacagcaccagcatgttcttgtacagcaacttaacgcggcacatttgcgggatcgcaatagtccagaaagcgccgtagcgcgttggaaaggtgtttttgccgatgatgtatacgccacaacgtacgcatcaggcgcggcagagggaccgcaacttcacttaatgtgcctgcctgcaattgatcttcaatcacacgtcgcgacaggcaactaattcccaacccatgacgcaccgcatgtttgattgcctcggagttacctaattccatcgccatctcaaacttcggtaaatgtgacagcaacagataatcgacaatctcccgcgtgccggaaccgcgttcacgcaggatccacggcgcagcggccagctgttctaaggtgaccggaccacgggccaacggcgaagtcggcgcggcgaaaaccaccagctcgtcttccagccacggttcagaaatgatttcagtgctgtggcacggtccttcaataaagccaatatcaacgcggaaatccagcaccgcttgcatcacgtcctggctattcccaacgctaagttcaatcggcaactgcggataatcatggcgataacgggcgataactgcaggcagaatgtagttaccgatggtactactggcatagatacgaatcgcgccgttgtcttcgcgaaacagttgttcgatttcaaccgcctgttcaagcaatgccaacgcacgcggatagagcagccgcccgtgttcattaacaaccagtcttttccccacgcgatcaaacagttgcacgccaagctgcccttccaggtcggtcaaggctgcgctcactgctgattgcgacaacgccagcatcaccgacgcctgggtggttgatccacttttcaatacttctgcaaaaacttccaactgccggagggtgatgtgcatagtcgcttaccacttataaagattaattataaatatataatcaattttatttttaaaccagttagtcgtaaccttatgcccggttaaaggagagggttatgacgaatatcaccttacagaaacaacatcgtacactgtggcattttattccggggttagccctgagtgcagttatcaccggggtcgccctgtggggtggttccattcccgcggttgcgggtgccgggtttagtgccctcaccctcgcaatcttgttggggatggttttaggcaacaccatctatccgcacatctggaaaagctgtgacggtggtgtgctgtttgccaagcaatatttattacgtctgggtatcattctttatggcttccgtctgacgttctcgcaaattgccgatgtcggtatcagtgggatcatcattgacgtgttgacgctgtccagtaccttcctgctggcttgcttcctggggcagaaagtgtttggtctggataagcacaccagctggttgatcggtgccggtagcagtatctgtggtgctgccgcggtactggcgactgagccggtagtgaaagcggaagccagtaaagtaaccgtggctgttgcaaccgttgttatcttcgggaccgtcgcgattttcctctacccggcgatatatccgctgatgtctcaatggtttagtccggaaactttcggtatctacattggttctactgtgcacgaagtggcgcaggtggtggcggcaggtcatgccatcagcccggatgcggaaaacgcagcagttatttccaaaatgctgcgcgtgatgatgctggctccgttcctcatcctgctggcggcgcgtgttaaacagctgtctggggcgaacagcggcgagaaaagcaaaatcactattccgtggtttgccatcttgttcatcgtagttgccatctttaactcgttccacctgttaccgcagagcgtggtgaacatgctggtaacgctggataccttcctgctggcaatggcgatggcggcgctgggtctgaccactcacgtcagcgcgctgaaaaaagctggggcgaaacctctgctgatggcactggtactgtttgcctggctgattgttggtggtggtgcgattaactatgtgattcaaagcgtcatcgcataaaccactacatcttgctcctgttaacccgctatcattaccgttttcctccagcgggtttaacaggagtcctcgcatgaaatacattggagcgcacgttagtgctgctggcggtctggcaaatgccgcaattcgcgccgccgaaatcgacgcaaccgcgtttgccttgttcaccaaaaaccaacgtcagtggcgtgccgcaccgctcacgacgcaaaccatcgatgaattcaaagccgcctgtgaaaaatatcactacacatcggcgcaaattcttccccacgacagttatctgattaacctcggacatccggtcactgaagctctggaaaaatcgcgcgatgcctttatagatgaaatgcagcgttgcgaacagctggggctttctttgctcaacttccaccctggcagccatctgatgcagatttcagaagaggattgccttgcgcgtattgccgaatccatcaacattgcgctggataaaactcaaggtgtgacagcggtgatagaaaacaccgccggtcagggcagtaacttagggtttaaattcgaacatctcgcggcgattatcgacggcgtggaagataaatcccgcgtcggcgtctgcattgatacctgccatgctttcgctgccgggtatgatttgcgtactccagccgaatgcgagaaaacattcgcggattttgcccgtactgtcggctttaagtatctgcgcgggatgcaccttaacgatgcgaaaagcacctttggcagccgcgttgaccgccatcatagcctcggtgaaggcaatatcggtcatgatgcgttccgctggatcatgcaggacgaccgtttcgacggcattccgctgatcctcgaaaccatcaacccggatatctgggcagaagagatcgcctggctgaaagcgcaacaaactgaaaaagcggtagcctgaagatgaataaccgggaaaaggagatccttgcaattttacggcgtaacccgctgattcagcagaacgaaattgcggacatgctgcaaatcagccgttcgcgcgttgcggcgcatattatggatttaatgcgcaaaggccggattaaaggcaaaggttacattctcaccgagcaggaatactgcgtagtggtggggacaatcaatatggatattcgcgggatggcggatatccgttacccgcaatcggcttctcatcccggtacaattcattgctcagcgggcggcgtgggacgcaacatcgcccacaatctggcgctgttaggccgtgacgtccatttgctttcagtgattggcgatgacttttatggcgaaatgctcctggaagaaacgcgccgtgccggcgtgaatgtctccggctgcgttcgtttgcatggtcaaagcacatcgacgtatctggcaattgccaatcgagacgatcaaaccgtgctggcgattaacgatacccatctgctggaacagttgacaccgcaactactgaacgggtcgcgcgatttacttcgtcatgcgggcgtggtactggctgattgcaacctgacagccgaggcgctggaatgggtctttaccctcgctgatgaaatcccggtgtttgtcgataccgtttcagaattcaaagcgggcaaaatcaaacactggctggcgcatattcacaccctgaaacccactttaccggagctggaaattttatggggacaggcgatcaccagcgatgctgaccgtaataccgcagtgaatgcattgcatcagcaaggtgttcagcaactgtttgtttatttgcccgatgagtcagtttattgcagcgaaaaggatggagaacaatttttgctgaccgcgccagcgcatacgacagtagacagttttggtgctgacgatggttttatggcgggcctggtatatagctttcttgaaggatacagtttccgcgacagcgcccgttttgcggtagcctgcgcggcaatttcgcgcgccagcggcagcttaaacaaccctaccctgtctgccgataacgcgctttcattagtgccaatggtgtaacaatgttgccggatgcgacgcttaacgcgtcttatccggcctacaaatcaggcaatttcagcaagtaaatgtaggcctgataagcttgcgcatcaggcaatgacactcaagctaaaccaataaagaacccggcaatggtcgcactcatcaagttggaaagcgtcgccgccgccagcgcccgtaaaccaagctgggcgatttccggcgcacggtgtggcgcaaccgcagaaaacgcccccaccaccaccccgatagaaccaaagttagcgaaaccgcacaacgcgaaggaaataatcgccacagttttagcatcgagagtgccagccgtttgcagatagggtgagaaattgagataagcgacaaattcatttattgccagtttctgtccaatcaaactcccggcaagattcgcatcactccagtccacacccatcacccacgccagtggagccagcaggtaacctaaaatggactccagcgaggcatgttcaaaaccaaaccagccaccaacgccgccgataataccgttaatcaacgcaattattgcaacaaatgccatcaccactgttgccacacctgcggcgattttcagcccggtcattgcccctgtcgcagcggcttcaataatgctttttggcggtgtttcggtgaaagagaggttattaaaggaaacctgcgaagattccgttgccgggcttaacaggcgggcaaacaagatcccgccagggatcgccattaatgatgccgccagcagatattccacaggcacgcccagtgcggcgtaaccaatcattgtcgaaccagcaatcgaggccatgccactacaaatcgctgtaaataattcattgcgattcagacgatcgataaagggtttgacgattgccggaatttcgttttgcccgaggaaaatggtggtgaccgcgacgaatgactcgatcttgctgatatttaatgctttctggaagataccgccgagaattcgaattaaaatccccatcacaccgatgtagtagagaatactcaccagcgcggtgacgaagataattgccggtaacaccctgaaaccaaagataaatcctgcaccatcaaataaggtatccattttcggtccgaccagagaaccgaagataaatgcgctacccgcgtcgctgtacgccatcactttatgcacgccaaaagcgactttttcagcgacccaacgccctggcggtaaccaaagcataatgccgccaatcacgacctgtaacactaacgccgcgccaacggtacgcaggctgatcttcttcttgtttactgacagtaaaaacgcaatcgtcagcaataccaccattcccagaacacttctcatgacatccatagtgattatctcttcatgtcatattgggcgacggctttctgcccatcagaaatagccaggcctgcatcttgcgataccggcccggcttgttatcaacacttaatgggttttgatgtagccgcgcacgcactcttcgactaatccccagaaccagtctgtatcaatagtgatgccgactttggtattggcgggcttgccaagaacgcccagctcgtcgcagacggtacgcccatagcaagggccactgttgacgtccacttcgacgtacatctcctgggttttaatgccatcagggttaatcagataaccgatgcaggtggcgtcgtgcaccgggccgccagcaaggccgtagttttcgaactgcgttttgagagtgaagttcatgatgtcgctgaacagctctccggcggggccgcctgccctttccatccgagcaatcacgtccggggtgcaaacggtctggttggtgagatcgaggcccatcatcactaatggaacgccggaggtgaacactacgcgtgcggcttccgggtcggcaaagatgttgaactcggcagatggcgtgaagttgcctgtaccgtaagcgccgcccattagcacaatttcacggattttgggcaggatcgcgggttgcatacgcattgccaccgcgatatttgaaagcggaccaaccggcaccagagtgatatcgccatcgcttgccatcagggtatcaatgatatatttcaccgcatgagtgctttctgcctggcgggtcagcggctcgaataccgggccatccagtccggtttcaccgtgaatattatcggcaacgatttgttgacgcataatgggctgcggcatccccgcataaaccggaacattaatctccagtttctggcaaacattcaggccattaattaatgttttatcaagcgtctgattacccgctacaatagtgatgcctaataaatctattgccggatgtttcgccgccatcattatagcaatagcatcatcatgacccggatcacaatccagaataatttttctcttttccattgtttatttcctctgtttccagttgcgttattttttctacagcaaagaaaattcgaccgggccgatgattgaatcttaacaacagcgtacgtatgctaaatatgagaaatctcatagcggataaacatcgtgaaagaaatccacaataatgatcttaagcagcaattgatgagtgaatccgcgtttaaggattgctttttaacggatgtttcagccgatacgcggctgtttcattttttagcgcgtgactacattgtgcaggaagggcaacagccgtcctggctgttttacctgacgcgaggccgcgccaggctttacgccacgctagctaatggtcgcgtgtcgctgatcgatttctttgccgccccctgttttattggcgagattgagttaatcgataaagaccatgaaccgcgtgcggtgcaggctattgaagagtgttggtgccttgcgctccctatgaaacattaccgtccgctgttattaaacgacacgctatttttacgaaaactctgcgtcaccttaagtcataaaaattatcgtaatattgtttctttaactcagaatcaatcatttccgttagtgaatcgcctggcagcatttatattactctcgcaggaaggtgatctttatcacgaaaagcatacgcaagcggcagagtatttaggcgtttcttatcgacatcttttatatgttctcgcgcagttcattcacgacggtttattaattaaaagcaagaaagggtatctcattaaaaacagaaagcagttgtcaggactggcgctggagatggacccggagaataaattctccgggatgatgcagtaaaaattattttcaatagcgcgattgccggatgcaacgcttaatacgttttatccggtctacaaatcgagcattacgccagaccaataaagaacccggcaatagtcgcactcatcaggttggaaagcgttgctgctgccagcgcccgtaaaccaagctgggcgatttccggcgcgcgttttggcgaaatagccgaaaatgcgccaacgacaacaccgatagaaccaaagttagcaaaaccacaaagcgcaaaggagataatcgcaatggttttcacttccagcgtgccgcccgtttgcaggtatggggagaaactcaggtaagcgacgaattcgttaatcgccagtttctgcccaatcaggctacccgcaagattggcatcactccagtccacacccatgatccacgccagcggtgccagcacatagccaaaaatactttccagagaggcattggcgaaaccaaaccagccgccaattccgccgataatgccgttgatcagcgcaataattgcgacaaacgccattaccaccgtcgccacaccagcggcgatttttagcccggtcatcgcaccgctcgccgccgcttcgataaagctttttggcggcgtttcgctgaacgacagattttcaaatgtgacctgcgaaggctcggttgccgggctaagaatacgtgcaaacaaaatcccgccagggatcgccatcagcgatgccgctaacaggtagtcaattggtacgcccattccggcataaccaatcatcatcgaaccagcaatggacgccatcccgctacaaattgcggtaaacaactcgttgcgattcatgcgatcgataaacggtttaacgatcgccgggatctcattttgcccgaggaaaatagtagtaaccgcaacaaaagattcgattttgctgatgttgagggctttctggaaaatgctgccaaggatgcgaatcagcagccccatcacgccaatgtagtacagcagactgatgagcgcagtaacgaaaataatcgccggaagtacgcgaaaggcgaagataaaacccgcaccgtcaaacaggacatccattttcggcccaaccagcgaaccaaaaatgaaggcgctaccggcatcactgtaagacatcactttatgaacgcctaatgccgcctgttctactgcccattttcccggtgggaagtagagcatgatgccaccaatagcgatttgcagcagcagtgcggctccaaccgtgcgcaaactgatgctctttttattcactgacaacagaaatgctattgccagtaacaccaccatccccacaacacttctcattatatccataatgattttcccttcatgccggtaaacccggcgtcagcgccaggttttggtatgcttgatgagtacgggcgacggctttctgcccgtcagaaattaacccgcgagacgctgatattctttggcaatttcgctcgccagaatggcgttgttgaacaccagctggatgttggatttcaggctgtcaccgccggtcagttcagcaacgcgcgccagcaggaatggcgtactttctttaccaatgactccctgagcttcagcttcagctaccgcctgatcgatcgccgcattgatagtgtgttccggcatagcaaactgttccgggatcgggttcgctaccacgaggccaccgttcagaccgctttgccatttcaccaccattgcacgggcaatttcgctggcgctgtcgagacgaatgctgacgtcaaacgggctggtgcggcagaaaaacgcaggcagcgctttagtctgatagccaattaacggcacaccgaaggtttctaaatactcagtggttaatcctaaatcgagaatagatttcgccccggcacaaacaacggtgacattagtatttgccagttcttgcaaatcggcagaaatatcgaaggtatgttccgccccgcgatgcacaccaccaattcccccggtggcaaatactttaattccggcaagcgccgcaataatcatcgttgaagccacagtggttgcgccattttttccggcggcaacaacaaaaggtaaatcgcgacgactaactttggtcacgttatgcccttcacgacccagtaattcaatttcttctttgcttaaccccactttcatcacgccgccaataatggcgatcgtggcaggtacagcgccctgtttacgaatagtttcttcaacttcaattgcggtctgggcattttgtgggaacggcatcccgtgagaaataatggtcgattccagcgccacaaccggttttttgttttttaaagcgtcctgcacttccggggaaatttgtaataattcaggggaaatttttaattcagacattctgcgttctccactaacgatataacgttggcaatcgataaatcggggttattggtgtattcacaggagagcgccattgacgaacatccctgtgcgaaacgaacagattcggcaaacggcattccgtctacccaacacgaagcaagtcccgccatcatggcatcgcccgctccggtaacattaataacattggttttgatcggcgcagaccagccactttcaccgctgatatcgctgtaataaacgccgtcgccgcccatgctcaataccagtcggttcaggccatgttgatggaaccaggcagcaacttttgccacatcttcacgccctgacagcgcaatcccactcagggtttccgcttcaaggcggtttggcttgagagtgtggatctgatttagacggtcgcgcactttgacacatttccatgccgaaaccggatcgacaaatacgggtacgttggcggcattatccagaatccatgccagtgcctcttcactgatattacagtccgcgacaatgacctttgccctctgaataaattcaccgtgctgtgcgagatattcagctgtaatagcgttgctaatattcatgtcatttatagcaaccagcatttcaccggtattatcgagtaatgataaataactcgacgtattttctcccggcacaatcaggcatttatcgacataaacgccagattgattggtttgcgttagcagcgattgaccataaaaatcactgcctacggcgctcagtagccaggctttgttacccagcaacgccaggttttgtgcaatattgcgccctactccaccaggcgtaaattttattttacctggatttgaatccgcataatttaatgattcatgtgaatatccggcgacatcaatattcgccgaacctataattacgacataatccttttcgcgcatagcacgtcctctggtaaaaaattaccaaccctgtcaatccacaagaatatagatactgcaaagacggtttaaacatgtgttcatatttaaacatgtgctcatagtatgcatgttttacgtaaagtaaattaccgccagagaggcaaaatgggcagatttgagcaggctcacaaaatgcgattaaatgcctgaattacaaaagcgaggaatttgtgacgggatgcacagaacagaacaataaaaaagggcagaaaataatctgcccttgaggaaataacctgagtgtttgatgaacgtttgaagtttctactgaaagataaaaccatttaaattcataaaattacattcacaaaccggtcattctctttgcgctcatcaaatgttacaggacaggaaatttctgccctgtaacacaccttttattacgctgctttcgctactgcgtccacttccggacgtttcaggaaggcataggccaaacccgccaccagcgtaccggcaataattgctaccaggtaacccaataccggcgtaatagcgccagggatcagcagaacaaacagaccaccgtgcggtgccatcagtttcgcaccaatcgccattgagattgcgccagtcagcgccccacccacgatacagcacggcagcacacgcatcggatcacgagcagcaaacggaattgcaccttccgaaatgaagcacagtcccaataccagagcggctttgccaccttcctgctgcgctttgtcgaatttgcgacgcgccaccattgttgccagacccattgccagcggtggcaccatacctgccgccataatcgccgccatcgggccataggtttgagtactcagcagacccacaccgaatgcgtacgctgctttgtttaccggaccgcccatgtcagtacacatcatgccaccgaggatcgcccccagcagaaccgcattcgcagtccccatggtctgcagccagtgagtcagcccttcgagaatgccagcaactggtttaccgatcaggtagatcatcgccagaccgaccaccagactggaaattagcggaatgatcaggatcggtttcagcgcctccatactctgtggcagtttcaattgcgtactgattaacttcgcaatgtaaccagccaggaagcccgcaataataccaccaatgaagccagaaccggtgctgaccgccagcataccgccaatcagacccggagtgaggcccggacgatcggcaatggaaaaggcaatataacctgccagtaccggcaccatcagcgcaaaggctgaaccaccaccaatctgcatcagcgccgcagccaacgtacccggctctttaaacgcttcgataccaaaagcaaaagaaagcgcgatacacagaccacctgcaacgaccatcggcagcatgtaagaaacgcccgtcagcaagtgacggtatgcgcctgcactctctttcttactttcagtggtcgccgtttgagctttgcccgccggttcatacggcgttgcttcagcaaccgctttatccagttcctgcgcggttttcttcagcgccagaccggtagaggtacgatacatcggtttaccagcaaatttcgccagatccacttcgatatctgccgccacaatcaccagatccgctgctgcgacttcttcgggagtgattgcattacccgcgccaacagaaccacgggtttcaactttcacccaccagccacgttttttcgcttcggtttcaatggcttcagccgccataaaggtgtgtgctacgccagtcgggcaagcagtcaccgcaactacgcgtttcggaccgctggcggcaactggtgctgtcgcagcgaccggcgcagtgtaaggtttcgcatggcctttggcttcactcaggaacagctcagggtgcgcaactgcccgggaaatatcgcccagccagacatttttaccgttcagcgcgctgtcgttcgggatggaatcaccgagaacaatcgccatttcagcgtcgttcggattgtcgatgatttccagttttgcttttcgcgccgccgcgcccagcagggtcttcgccatataggcgcgtgcctgaccgagattagcgtcaataatcagcagcgttttcattatgcctctcctgctgtcagttaaaaggttgtaagtcgacgcgcgccatcattgcggccaactgcggacgatcggtaatacccacattgctttgacttaccgccagggctgcaacagctgtcgccagacgcagtgtgtgttcactggattcacgcatcagcaagccataaatcaggccaccaaccatagaatcccctgcgccaacggtgcttacgacatcgactgacggtggtttggcgatccattcgccggaggcattaacccaaagcgcgccttcggcacccagtgaaataacaacatgcgcgatgccttgttcacgtagcgcatgtgcagcttcaatcacatctttcatttcaggcagtttacggcctgcccagatttccagctcgcggcggttaggtttcaccagccacggtgccgctttcaaacctgctactaacgcttcacggctactatcaaagataatgcaaggacactgactacgcaggcgagtcatccagtcggtgaacgcttccgggctgacgcctgacggtaagcttccgctgacacagaccatatcgaactgaccgagccagctcagagaatcagtcacaaagcgttcccagtcggcgggggtgacttcaaaacccgagaagttgaagtcggtcacttcgccgtctttttccgtcagcttaacgttaattcgggtgcgcccctgtacaacctggaaacggttggcaatgcccagctcgctgaacagttgctgaaaaccatcctgattgtctttacccaggaagccgccaacggtgacatcaattcccaggtcttttaatactttggccacgttgatgcctttacccgccgcatgcagaccggtggttttcaccaggttcacttcgccgcgttcaatttccgggcagaaaccaacaaggtcataagccggattaagggtgatagtagcaacacgtctgctcattatgcgccctccccaagaccagcagcgatagcgtcgccgattgctttcagcgcctgttcagcatctgcaccctgggcggtaaagcgtaggcgatgacctttcttaacgccaagtgccacaactttcatcagactacgtccgtttgccggtttgccggtaccatcaaggtttgtcacggtaatatcactgttaaattgtttaatggtattgaccagcatggtacctggacgagcatgcaggccgtgttcattgcgcaccacaaactccgcgcttaacacgtcgtcggtcggcgcatcatcgctggtcagcagcgccagcaacgttgccgcatccgctttcagcaagcggtcagctttattgtcgagcaataaatcagcgagacgcttaagaaccgcgatgggctgatcgtcattcatcgccacactcaccagcatggctgccgtttcgccgtccacatcaaaagcatttgccgcacggcttaccgcaatcgcgctacgcagattgccttcggcgctatcgctcagccagataccctgtccgagattcagcggttgttcattgatggctttggtgacgaaagtggcgtcaactgcccccgcctctttcagacgcgcagcgttcagcgcctgaagagtcagcagatcgctggcgacgatatccagtgtcagcatttcgttgtcgagcttcagctgctcactctgcttttcgcccatcagtaatgcgcgaagttcttctgctgttgttgctgacttcagttgttcagcaacggaatcatcgctcagtacgtgggtcagctggcgtagcaggcccagatgttcatccgagctggcagcaataccgattgccacgtacgctacctgaccgtcaccccaggtgacgccttccgggaactgaaatacctgaacgccggttttcagcacctgatcgcgggtgtcggtagtgccgtgtggaatagcaataccattgccgaggaacgttgaggtttgctgttcgcgcgccagcatgccattgacgtagccttctgctacattaccggcctgcaccagcgccgcagcgacctggcgaatcgcctcttctttgtctccggccttttcgcccggatggatgtcctgtacggataactggaacatagttctcctctcttgctgaattgaaacgattcagcctctatgagaaaaaaagcgccaacctggcttagggttaaagacaagatcgcgctgaaacgtttcaagaaagcataatacttctgtttcagcacgcaaggaaagccgtaaagttatgagcaaaagtttgatgtgctgcacaattttttgccatttttcctaattgctgatgggaaaatccgttatcagcaatttcatttcagcagcgtcagcagccaatcagcaacagtgaaatggcattttgactattcgtggcgcttttgatttcgctgtctgtttattttctgacaagcagcgtaaactccgcgtcttcctcttccagtgatcgaccagcatgcataactcccccgcagtctccagcgcgaaatcgtttgacctgacctcgacggcgtttttaatcgttgcctttctcaccggtattgcgggcgctctgcaaaccccgacactcagtatttttcttaccgatgaagtacatgcccgtccggcgatggtgggattcttctttaccggcagcgctgtcattgggattctggtaagtcagtttctcgccgggcgctctgataagcgcggcgatcgcaaatcgctgattgtcttttgctgcctgttaggcgtgctggcctgcaccctttttgcctggaatcgcaactactttgttttgctattcgttggcgtctttcttagcagctttggctcgaccgctaacccgcaaatgtttgcccttgcccgtgaacatgccgacaaaaccggacgtgaggcggtgatgttcagctcttttttacgcgctcaggtttcactggcatgggtcattggcccaccgctggcttatgccttagcgatgggtttcagctttacggtaatgtatctgagcgcagcggtagcgtttattgtttgcggtgtgatggtgtggctgtttttaccgtcgatgcgaaaagagcttccgctggcgaccggcacgatcgaagcgccgcgccgtaaccgtcgcgatacgctgctgctgtttgtcatttgtacattgatgtggggctcgaacagcctgtacatcatcaacatgccgctatttattatcaacgaactgcatcttcccgagaaactggccggtgtgatgatggggaccgccgccgggctggaaatcccgacgatgttgattgccggatatttcgccaaacgtctgggtaagcgtttcttaatgcgcgttgctgccgtgggtggcgtctgtttttacgcaggaatgctgatggcgcattcacctgtcattctgttgggcttgcagctgctaaatgctatttttattggcattctgggcggcatcgggatgctctattttcaggatctgatgcccggtcaggcgggttcagccaccacgctctataccaacacttcgcgcgtgggctggatcatcgcaggatcagtggcgggcatcgtcgccgagatctggaattatcacgctgtgttctggtttgcgatggtgatgattatcgccactctgttttgcttactgcggattaaagatgtttaaggcgcggtcagcatttccagatcgataagccaggtcatggcctgctgacgcgagttaccgcacatttcagcgctggcttgtaagcctgcacagactttcggtcgcagtggcgaggtgaaaattttacagcgttgctgttcatcaagctgaatgcagggcgtattggcgggcttgccatctggcataccgggaatagggctggaaattgaaggggcagtgcaacacgccccgcaacccggacggcattccatacgttgttctcttaaggttaaccaccggattgatgagcgcgcacagtaccaccttttttgcaccagcaaaagtgcgaataccacttgcccgaaaggcccgtcgcgagtactttgtcgcgatatttttgacattttcgactacaggaatttttcgatgccaagagcgaacgaaattaaaaaaggtatggtactgaattacaacggcaaactgctgctggttaaggatattgatattcagtcgcccactgcccgcggtgccgctacgctgtacaaaatgcgtttttctgatgtccgtaccgggctgaaagtagaagagcgtttcaaaggtgatgatatcgttgacaccgtgacgctgacccgccgttacgttgacttctcctatgtcgatggcaacgaatatgtctttatggataaagaagactataccccgtataccttcaccaaagatcagattgaagaagagttgctgtttatgccagagggcggcatgccggacatgcaggtgctgacctgggacggtcaactgctggcgcttgagctgccgcagaccgttgatctggaaatcgttgaaaccgcaccaggcatcaaaggggcatctgccagcgcccgtaacaaaccggcgacattgagcactggtctggtgattcaggtaccagaatacttaagcccgggcgaaaaaattcgtatccatatcgaagaacgccgttatatggggcgtgctgactaacttcagccgcatgcagaaaagggatagctcaggctgtcccttttttaatttattataccaatcttctattttgcgcttcctgaacaccttacgccctcaattttcactcgttgattgatcgccctcacacttcatcgcattaacaatccagaccaatttcaattgctgtcatataactttacactgtcgttgttaattaatcgttactaagacgtgactcctatgaatacaatcgcctccgttacgctcccgcatcatgtacacgctccacgctatgatcgccagcagttgcaatcacgtatcgttcattttggctttggagcctttcaccgcgctcatcaggcgttactgaccgatcgtgtgctgaatgcccagggcggcgactgggggatctgtgaaatcagcttgttcagcggtgatcaactgatgagccagctccgcgcacagaaccatttatataccgtgctggagaaaggtgcggacggcaatcaggtgataattgtcggtgccgttcacgaatgccttaatgcaaaactggattccttagcggcaattattgagaaattttgcgagccacaggtggcaattgtttccctgacgattaccgaaaaaggctattgtattgacccggccaccggtgcactcgacaccagtaatccgcggattattcacgatctacaaacccctgaagaacctcactccgcaccgggtattctcgtcgaagcactgaaacgccgccgtgagcgcggccttacaccgtttaccgtgctctcctgcgacaatattcccgacaatggtcatgtggtgaaaaacgcggtgctgggaatggcagaaaaacgttcgccagaactcgccgggtggataaaagagcacgtcagttttccgggaaccatggtcgaccgcattgttccggctgcaaccgacgaatcactggtggaaatcagccagcatctgggggtgaatgatccctgcgcgattagctgcgaaccgtttatccagtgggtggtggaagataacttcgtcgctgggcgtcctgcctgggaagtcgcaggtgtacaaatggtgaatgatgtcctgccatgggaagagatgaaactgcggatgcttaatggcagccactcttttctcgcttatctgggttacctctcaggattcgcccatatcagtgattgcatgcaggatcgcgcatttcgccatgccgccagaacattaatgctggatgagcaagcgccgacactgcaaattaaagatgtcgatttaacacaatatgcggataagttaattgcacgttttgctaatccggcgctgaaacataagacctggcaaatcgcgatggatggcagccagaaattaccgcaacgcatgctggcaggtattcgcatacatcaggggcgcgaaacggactggtcgttgctggcattaggcgttgcaggctggatgcgttacgtcagcggcgttgatgatgccggaaatgccattgatgttcgcgatccgcttagcgataaaattcgcgaacttgttgcgggcagcagcagtgaacaacgcgtaaccgccctgctttccctgcgtgaagttttcggtgatgatctgccagataacccgcattttgtgcaggccatcgaacaagcctggcaacaaatcgtacaattcggcgcacatcaggcgctattaaacaccctcaaaatttaacgatttctgcggttaaagcggatgaagctcaccttcgtccgctctccccttctcttttctgccttttttagccaggattaacgctcagttaacttaccagagtattgcggagccgttgtgaccaggaccaacctcatcaccggttttctcggcagcgggaaaaccacgtcgattcttcatctgttagcccataaagatcccaacgaaaaatgggcggtactggttaatgaatttggggaagtcggaattgatggtgctttgctcgccgatagcggcgcattgctgaaagagatccccggcggctgcatgtgctgcgttaatggtttacccatgcaggtagggttgaataccttactgcgtcagggaaaaccagaccgcttgttgatagagccgaccgggctgggccatccgaaacagatcctcgatctgttaaccgcaccagtctatgaaccgtggatagatctgcgcgccaccttgtgcattctcgatccgcgcttgctgctggacgaaaaaagcgccagcaatgaaaacttccgtgaccagctggctgccgcagacatcattgtcgccaataaatccgaccgtacgacgcccgaaagtgagcaagcgctacagcgttggtggcagcaaaatggtggcgatcgacaattaattcacagtgagcatgggaaagttgacggtcatcttctggatttgccgcgtcgcaatttagccgagttgcccgccagcgccgcgcattctcatcagcatgtcgtgaaaaaagggttagcagcgttaagcctgccagagcatcaacgctggcgtcgcagtctgaacagcgggcaaggatatcaggcctgcggctggatattcgacgctgatacggtattcgacaccattggcattctggaatgggcgcgacttgcaccggtggaacgcgtcaaaggcgtgctgcgtattcccgaagggctggtgcgaatcaaccgtcagggcgatgacctgcacattgaaacgcaaaacgttgcgccaccggacagccgtattgagctgatttccagcagcgaagctgactggaatgccttgcagagcgcgctgttgaagcttcgtttagcgactaccgcgtaaggttgcctgcgtttttcagtaagataattagagaaaatatgattaaaaatttgccgcaaatagtgttgttgaatattgtcggcctcgcgctgtttctttcctggtatatccccgttaatcatggattctggttgccgattgatgcggatattttttatttctttaatcagaaactggtcgaaagtaaggcctttttgtggctggttgcattgaccaacaatcgcgccttcgacggttgttcactgctggcgatgggtatgttgatgctgagtttctggctgaaagaaaacgcccctggcagacgacgtatcgtgattattggtctggtcatgctattaactgcagtggtattaaaccagctgggtcaggcattaattcctgtaaaacgggccagcccaacattgacttttaccgatattaaccgcgtcagcgaactgctctctgttcccacgaaagatgcctcacgagatagctttcccggcgatcacggcatgatgctgcttattttttcggcattcatgtggcgttatttcggcaaagttgcaggccttatcgcccttattatttttgtggtttttgcatttcccagagtaatgattggcgcacactggtttactgacatcattgtcggttcgatgaccgtgatattgatcggtttgccctgggtgttgctgacgccattaagtgatcgattaatcaccttttttgacaaatcactaccaggaaaaaacaaacatttccaaaacaaataactcacagtaattaacatcatcagggttatttttatagtgaggataatcctgatgatgcgcaccgtgctttcatctatcgaacgcaaaaatcattctctaagtaaatgaatggattgcatgcgtttcactcaattgtactttaattgaccaaccccgcttattaactttctgtatcactttttcttataaaaaatcatgtaaaaccgctcgccaagaccgcaccaatcgggtaatctcgaactcgttttgcctcggcggtagattatcctcacagcatataattttgtgcgttagtccacagatttggccttaaggaattgtttcaacatgcccaggtaattagtctcgtgtcgcttggcatttttttataacgatatttgtcgttaaggacttcaagggaaaacaaacaacatggtcaaatctcaaccgattttgagatatatcttgcgcgggattcccgcgattgcagtagcggttctgctttctgcatgtagtgcaaataacaccgcaaagaatatgcatcctgagacacgtgcagtgggtagtgaaacatcatcactgcaagcttctcaggatgaatttgaaaacctggttcgtaatgtcgacgtaaaatcgcgaattatggatcagtatgctgactggaaaggcgtacgttatcgtctgggcggcagcactaaaaaaggtatcgattgttctggtttcgtacagcgtacattccgtgagcaatttggcttagaacttccgcgttcgacttacgaacagcaggaaatgggtaaatctgtttcccgcagtaatttgcgtacgggtgatttagttctgttccgtgccggttcaacgggacgccatgtcggtatttatatcggcaacaatcagtttgtccatgcttccaccagcagtggtgttattatttccagcatgaatgaaccgtactggaagaagcgttacaacgaagcacgccgggttctcagccgcagctaataaaccgtttggatgcaatcccttggctatcctgacgagttaactgaaagcactgcttaggcagtgcttttttgttttcattcatcagagaaaatgatgtttccgcgtcttgatccaggctatagtccggtcattgttatcttttaaatgttgtcgtaatttcaggaaattaacggaatcatgttcatacgcgctcccaattttggacgtaagctcctgcttacctgcattgttgcaggcgtaatgattgcgatactggtgagttgccttcagtttttagtggcctggcataagcacgaagtcaaatacgacacactgattaccgacgtacaaaagtatctcgatacctattttgccgacctgaaatccactactgaccggctccagccgctgaccttagatacctgccagcaagctaaccccgaactgaccgcccgcgcagcgtttagcatgaatgtccgaacgtttgtgctggtgaaagataaaaaaacattctgttcatctgcgaccggtgagatggacattccactcaatgaattgattccggcgctcgacattaataaaaacgtcgatatggcgatcttacccggcacgccgatggtgccgaacaaacccgcaatcgtcatctggtatcgcaaccctttgctgaaaaatagcggcgtctttgccgctctgaatctcaacctgacgccttcactcttttatagttcacggcaggaagattacgatggcgtcgccctcattattggcaatactgcgctatctaccttttcttcacgtttgatgaacgttaacgaattaaccgacatgccagtccgtgaaactaaaattgcgggcattcctctgaccgttcggctttatgcagatgactggacatggaacgatgtgtggtacgcatttttactgggcggcatgagtggaactgtcgttggcctgctctgctattacctgatgagcgtacgtatgcgccccggcagagaaatcatgaccgccatcaagcgcgaacaattttacgtggcgtatcaaccggtggtggatacacaagctttgcgagtaacgggcctggaagtactgctacgctggcggcatcctgtcgcgggagaaattcccccggatgccttcattaactttgccgaatcgcaaaagatgattgtgccgctgactcagcacctgtttgagttaattgcccgcgatgccgcagaattagaaaaagtgctgccggtaggcgtcaaatttggtattaacattgcgccggaccatctgcacagcgaaagctttaaagcagatatccagaaactgctcacttccctgcccgcacaccatttccagattgtgctggaaattaccgagcgcgatatgttgaaagagcaagaagccacacaactcttcgcctggctgcactcggtcggcgtagaaattgctattgatgacttcggcaccgggcacagcgcgcttatctatcttgagcgttttacgctcgattatctgaaaattgaccgtggatttatcaacgccatcggtacggaaacgatcacttcccccgtacttgacgcggtgctgacgctggcgaaacgcctcaatatgctgacggttgctgaaggggtcgaaacgccggaacaggcgcgatggctaagcgaacgcggcgttaatttcatgcaaggctactggattagccgcccgttaccgctggacgattttgttcgctggctaaagaaaccgtatacgccgcagtggtaaggtgtgcttacgtcccttattattcatagtgaaagcatgccggattgcggctaatgatgagtaaaaggaaatccgttgcagatgattgtgcgcatactgctgctgtttatcgctctgttcacctttggtgtgcaggcgcaggctatcaaggaaagctatgcctttgccgtgctgggcgaaccccggtacgcgtttaatttcaaccattttgattatgtgaaccccgccgcgccaaaaggtgggcagataacgttgtcagccctcggcaccttcgataatttcaaccgctatgcactgcgcggcaacccgggcgcacgcaccgagcagctgtacgacacgctatttacgacttccgatgacgaaccaggcagttattacccgctgattgctgaaagcgcacgctatgctgacgattattcctgggtggaggtcgctattaatccgcgcgcccgttttcatgatggttcgcccattactgcccgcgatgtagagtttacttttcaaaaatttatgaccgaaggcgtgccgcaatttcgtctggtctacaaaggcaccaccgtcaaagccattgcaccgttaaccgtgcgcattgagttagctaaacccggcaaagaagatatgctgagtctgttttcgctgccggtatttccagaaaagtactggaaggatcacaaacttagcgacccgctcgccacgcctccgcttgccagtggtccgtaccgcgttacgtcctggaaaatggggcaaaatattgtctattcccgtgtgaaagattactgggcagcaaacttaccggtaaaccgtggacgctggaatttcgacaccattcgctacgattattacctcgatgataatgtcgcctttgaagcgtttaaagcaggtgcctttgatttgcgtatggaaaacgacgccaaaaactgggccacgcgttataccggtaaaaatttcgataaaaaatacatcatcaaagatgagcaaaagaacgaatcagcccaggatacgcgttggctggcgtttaatatccaacgtccggtattcagcgatcgccgggtccgggaagctatcactctcgcctttgactttgaatggatgaacaaggcgttgttttacaatgcctggagtcgcacgaacagttattttcagaataccgaatacgcggccagaaattaccccgacgccgcggagctggtgcttctggcaccaatgaaaaaagatctaccgtcagaagtcttcacacaaatctaccagccgccggtatccaaaggcgatggctacgatcgtgacaacctgttaaaagccgacaaacttctcaacgaagcgggctgggtgctgaagggtcagcaacgcgttaatgccacaacgggtcagccactcagctttgaattattgcttcccgcaagcagcaatagtcagtgggtattgccgttccagcacagcctgcaacggctgggtatcaacatggacattcgcaaggtggataactcgcaaatcactaaccgcatgcgcagtcgcgactatgacatgatgccgcgcgtatggcgggcgatgccgtggcccagttccgatttacagatttcctggtcatcggaatatatcaattccacttataatgcccccggcgtgcaaagcccggttatcgactcgctgatcaaccaaattattgccgcgcagggaaataaagaaaaattactgccgttggggcgagcactggatcgcgtattaacgtggaattattacatgctgccaatgtggtacatggcggaagaccgtctcgcctggtgggataaattctcccagccggccgtgcgccccatctatagcctcggtatcgatacctggtggtatgacgtcaataaagcggccaaactgccgtccgccagcaaacagggagagtagatgggcgcttacctgattcgccgtctgttgctggtgatcccaacattatgggcgattatcaccatcaactttttcatcgtgcaaattgcgcctggcggtccggtcgaccaggccatcgccgccattgagtttggtaatgccggagtattacccggcgcaggcggtgaaggtgttcgtgccagccatgcgcaaacgggtgtcggcaatatcagcgacagtaattaccgtggcggacgcggattagatccagaagtgatcgctgagatcactcatcgctacggttttgataagccgatccacgaacgttacttcaaaatgctctgggactacatccgctttgattttggcgatagcctgtttcgcagcgcctcggtgctgacgctgattaaagacagtctgccggtttccatcaccctcggattgtggagcacgctgattatctatctggtgtcgattccgttaggcattcgcaaagctgtttataatgggagccgctttgacgtctggagtagcgcatttatcatcatcggctacgccattccggcctttttgtttgccatcctgctgattgtcttcttcgcgggcggcagctatttcgacctgttccctctacgcggcctggtttccgctaactttgattcgctgccgtggtatcagaaaatcaccgattatctgtggcatatcacgctgccggtgctggcgacagtgattggtggctttgcggcgctgaccatgctgacaaaaaactcattccttgatgaagtgcgcaagcaatacgtggtgaccgcgcgtgcgaaaggggtaagtgaaaaaaatattctctggaaacatgtgttccgcaacgccatgctgctggtgattgccggttttccggcgacgtttatcagcatgttttttaccggctcgctgctgattgaggtgatgttttcactcaatggtctgggcttactgggctacgaagcgaccgtctcgcgcgattatcctgtaatgtttggtaccttgtatattttcaccctgattggcctgctgctgaatattgtcagtgatatcagctatacgctggttgatccgcgtattgattttgagggacgttaatgtcgcgactcagccccgtcaatcaggcccgttgggcgcgttttcgtcataaccgtcgcggctactggtcgttatggattttcctcgtcttgtttggtttgagtttgtgttctgaacttatcgccaacgataaaccgttgctggtgcgttatgacggcagttggtatttcccgttattgaaaaactacagcgaaagcgattttggcggcccgctggcaagtcaggctgattatcaggacccgtggctgaaacaacggctggaaaataacggctgggtactgtgggcaccgattcgctttggtgctaccagtatcaactttgctaccaataagcccttcccttctccaccctcccggcaaaactggctgggaacggatgccaacggcggcgatgtgctggcacgcattctctatggcacgcggatctcggttctgtttggcctgatgctgactctctgttccagcgtgatgggcgtgctggcgggggcgctacaaggctattacggcggtaaagtcgatctctggggacaacgctttattgaagtatggtcggggatgccgacgctgtttttgattattttactttccagcgtcgtacagcctaacttctggtggctgctggcaattactgtcttgtttggctggatgagtctggtcggcgtggtgcgggcggagtttttacgtactcgtaatttcgactacattcgtgcggcacaggcgcttggcgtcagcgatcgcagtatcatcctgcgtcatatgttgcctaatgccatggtcgcgaccctcacctttttaccgtttattttatgtagttcgataaccaccctgacctcgctcgatttcctcggcttcggtctaccgctcggttcaccgtcactcggtgaactgctgttacaagggaaaaataaccttcaggccccgtggcttgggatcaccgccttcttgtcggtggcgatattattgtctttgctgatctttattggtgaagccgtccgcgacgcatttgatcctaataaggcggtgtagcatgacgcaaactctgttagcgattgaaaatttgtcggtgggttttcgccatcagcaaaccgtacgtacagtagtcaatgatgtttcactacagattgaggctggcgaaacgctggcgctggtgggtgagtcaggttcaggcaaaagcgttaccgcgctgtcaattttacgcctgctcccttccccgccggttgaatatctctccggcgatattcgttttcatggcgaatcgctgcttcacgccagcgatcaaacgttgcgcggtgtacgcggtaataagatcgccatgatttttcaggaaccgatggtgtcgttaaatccattgcataccctggaaaaacagctttatgaagtgctttcactccaccgcgggatgcgtcgggaagcggctcgtggcgaaattcttaactgccttgatcgcgttggtatccgccaggcggcaaaacggctgacagattatccgcatcagctctccggcggcgaacggcagcgggtgatgattgcgatggcgctgttaacgcgaccggaattattaattgccgatgaaccgaccaccgcactggacgtctctgtccaggcgcagattttacagctgttgcgcgaactgcaaggcgagctgaatatgggcatgctgtttattactcataacctcagcattgtcagaaaactggcccaccgcgtggcggtaatgcaaaacggtcgctgtgtcgagcaaaattacgccgctacgctatttgcatcacccactcatccttacacacaaaagctactcaacagtgaaccgtcaggcgatccagtgccgttgccagaacctgcctcaacgttgctggatgttgaacagcttcaggttgccttccccattcgcaaagggattttgaagcgcattgtggatcataatgtggtggtgaaaaacatcagttttacgctacgagcgggtgaaacactgggtttagtgggcgagtccggttccgggaaaagtacgacgggactggcgctgctgcgactgattaattctcagggcagcatcatctttgacggtcagccactgcaaaatttaaatcgccgccagctgttacctattcgtcatcgcattcaggtggtatttcaggatccaaactcctcgctcaacccacgactcaacgttttgcagattattgaggaaggcttacgggttcaccagccgacgctttctgccgcacaacgcgaacaacaagtgatagccgtgatgcatgaagtgggattagatcctgaaacacgccaccgttatccggcggagttctctggtggtcagcgacaacgtattgcgattgccagggcattaattcttaagccctcgctgatcatacttgatgaaccgacatcatcactcgacaaaacggtacaggcgcaaatattgacgctattgaaatcattgcaacaaaagcatcaactggcctatttgtttatcagccacgatttgcacgttgtccgcgcgttatgtcatcaggttatcatactgcgacaaggggaagtagtggaacaaggaccgtgcgcgcgcgtgtttgccacaccgcagcaggagtatacgcgtcagctactggcgttgagctgacgcttaaaaaggattgtagtttgaaaagggttcggcaattgccacaccaaaatttttcaatcggcatgttgcagcaaactcgtcctggcgatttacaaacaggcacggctcaccttcacactccagcaccgaacatggaacttcgatgtcgcttaacgcctggcttagtttatacatcaccgaccatgcattatcaccatccgggctaagcaatttaagcgccaccaggctgttgtcaccgcacggtccattttgcggaatcggttcaaccttcgaacctgcgaaaccagcagaccagcgatagttctgcggcagtcgatggacgattgagagttgtaatgaagtcacttattttccccggaagcacattcacttcacaatttgtttacatcaattttaacacatcatcaacaatccgtctttatacagatcgtaaagattgatgcctcgcctgcgtggcctctatggctctgatttaagtaatatctgcgggcgtggtcacgtttgcggggctatatgtacccgtttctgcgatctaactcaacctttttaactacaatgatgtgactttttacataaattgattttacataaaataaacatatatcgggggaatgatagatttgtggttgacatgcatcaacaaaggaagccttttagcttcctcgttgtgcaatagatcaccgttttttcggccgactggcgtacagacagaagagaatggagctggttgcgcagaatgcaattgaccaaatcatcggccatgcagagttaaaggtcgcaagagaaagcaatgcgccaacaattgcccctatgccaaaacggaaggttcctgccagcgaagatgccgttcccgccatatggggaaactcatcaagaatgaccgccatcgcattggatgacaccatcgacacgcagcccacaaacgccgcaacgccaaccaccagcgaccaaaatcccagccccagcagcgcactgatgaccatccacgctgccataataaattgtatccacaaccccgagcggaacatatttaacgcgccaatgcggcggacgaagcggctgttaaagatggtcatcacgaacagaaaaacaatgtttagcgcaaagtaataaccaaagttttccggcgcgacgtggttaatttcaatataaacaaacggtccggcgcttaagaatgagaacatcccggcaaagctgaaaccactggcaagcatgtagctcaggacacgtttatggcggaacagcgccgcaaagttaccaatagtggtacgaatgtgaaatggctgacgacgctccggtggtaaggtttctttaatcaggaagaaaatcattgccgaagccagaatcgccgctaatgccaggatccagaagatgtaatgccagctcagccacaccagcacccagccgccaactatcggtgccatcagcggtgcaatggttgtcaccagcatgacaaacgacatcatccgcgagaactcttctttcgggtaaatatcgcgcatcagggcgttaatgaccacgctggccgcagccgcagccagcccgtggaagaaacgcatcacaatcagctgatcgatggtgtttgccaacgcacacgccaccgcggcggcggcaaacaccagcgtaccgccgagcaccaccggcttacgcccgaagctgtctgccatcggcccgtagattaactgccccaacgcaaagcccagaatataagtactgagggtcatctgcgtactgcccgccggtacgccaaactgcgctgaaattaccggtagcgcgggcagatacatatcaatcgacagcggcatcaacatggccagcaggccaaggataaaaacaatagcaaacgacgaatgctgtcgggtggtcacaacgggctcctgaaagtcattgaaaagttagacgacgctggcaatttcttcttcagttaacggacgatattcaccgggggctaaatcagcatccagcgtaataccgccaatacgttcacgatgcagctcaaccacgtggttacccacggcggcgaacatgcgtttcacctgatgataacgcccttcgctgatggtcagacgaacctgcgttggggtaatcacttccagcaccgcaggcttagtgagatctttttcgttatgcagctgcacgcctttagcaaattgctctgccgtatcgtcagctacaggtgattccagtgtcaccagataggtcttctcgcaatgatggcgcggagaagtaatgcggtgcgaccactgaccatcatcagtcatcagcaccagaccggtggtatcaatatccaaccgccccgccgcatgcagtttccacgctaccggttcatcaagaaaatagagcaccgttgggtgatcagggtcgtccgtggagcaaacatagccctgaggcttattgagcatgaagtaacgtggaccgtgttgctgcgccagcgggttgccatcgtaagcgacatcatgttcaggaagcagtttgaacgctgcattacggacgatttcgccatcgacggtgacacgattgccgcggatttcacgcccggcaatagcacggctaacgccgagttgctgtgcgataaatttatcaagtcgcatgtgtgtgattttgcctgtaaaaacggaggtcgggcattgacccgaaaatctgaactgttgtctgcccagtatagcggtctaataacatccctcaagggaaaaagatccatggcatactattagcagaataatctacctacgcgagaccatgatttttacacttcgcccatatcagcaagaagccgtggatgccacgctcaaccattttcgtcgtcataaaacccctgccgttatcgtgctgcccaccggcgcaggtaaaagcctggtgatagcggaactggcacggctggctcgtggtcgcgtgctggtgctggcacacgttaaagaactggtggcgcaaaaccatgcaaagtatcaggcgctggggctggaagccgatatttttgccgccgggctaaagcgcaaagagagccacggtaaagtggtatttggcagcgtgcagtctgtcgcccgtaatcttgatgcctttcagggtgaattttcgctgttgattgtcgatgaatgtcaccgtattggtgacgatgaagagagccagtatcagcaaatcctcactcacctgacaaaagtgaatccccacttacgcctgctggggctgactgccacgccttttcgattgggcaaaggctggatctaccagtttcattatcacggcatggtacgcggcgatgagaaagcccttttccgtgactgcatttatgagctgccgctgcgttatatgattaaacacggctatctgacgccgccagaacgactggatatgccagtagtgcaatacgatttcagccgcttgcaggcacagagtaacgggctgttcagcgaagccgatctcaaccgtgagctgaaaaaacaacaacgtattaccccgcacatcatcagccagattatggagtttgctgcaacgcgcaaaggggtgatgatttttgccgcgacggttgaacacgcaaaagagattgtgggattactgcctgccgaagatgcagcactgattactggcgacacccccggcgctgagcgcgatgtgttaattgaaaattttaaagcccagcgttttcgctatctggtcaacgtcgcggtactgaccaccggatttgacgccccgcacgtcgatcttatcgccattctgcgccctaccgaatcagtgagtctttaccaacaaattgtcgggcgcggtctgcgtctcgctccgggcaagactgattgcttaattcttgattatgcgggtaatcctcacgatctctacgcgccggaagttggtacaccaaaaggcaaaagtgacaacgttccggtacaggttttctgccctgcctgcggttttgccaacaccttttgggggaaaacgaccgccgacgggacattgattgaacactttggtcgtcgctgtcagggatggtttgaagatgacgacggtcatcgcgaacaatgtgacttccgtttccgttttaaaaattgcccgcaatgtaacgcggaaaacgatattgccgcccgccgctgccgcgaatgtgacaccgtactggttgatccggacgatatgttaaaagcggcgctacgactgaaagacgcgctggtattacgctgtagcggcatgtctttgcaacatgggcacgacgagaaaggcgaatggttgaaaatcacctattacgatgaagacggcgcggatgtgagtgagcgtttccgtctgcaaacacctgcccagcgtaccgccttcgagcagctttttatccgcccgcatacgcgcacaccgggcatcccgctgcgctggatcaccgccgccgatatcctcgcccagcaagccttattgcgacacccggattttgtcgtcgcccgcatgaaaggccagtactggcaggtgcgtgaaaaagtgttcgattacgaaggtcgttttcgtctggcgcacgaattacgcggttaatggtagttttgattgatgtataaggcgattgagtatagaatctcgcccgcttttgcatacgcaaagcagatcacttacctgttgctgggtcgcctgtagcaggattaatttaagagagaaagaaatgtttactatcaacgcagaagtacgtaaagagcagggtaagggtgcgagccgccgcctgcgtgccgctaacaagttcccggcaatcatctacggtggcaaagaagcgccgctggctatcgagctggatcacgacaaagtcatgaacatgcaagctaaagctgaattctacagcgaagttctgaccatcgttgttgacggtaaagaaatcaaagttaaagctcaggacgtacagcgtcacccgtacaaaccgaagctgcagcacatcgacttcgttcgcgcttaattgctgaataagttgtaaaaaaccccgctccggcggggttttttgtatctgcagattatgcctgattacggtattgctattttttgcaggccagataaggcgttcacgccgcatctggcattcagaacacaaaaccgattaattgccgccagacgtccggcgctgcaattggtcgcgcaaattcggcggcgtgcctttaatggtcaaggtatcggttgctggatcccagaagatgcgttcacctaacagcatcgcatcaaagttaatagtcaagccaccgccgctaccggcaaacttcgtcaactgacgcagtgtgctacggtctgccgggaagctctcttccagttcgtagcctttttcagccgcaaactccgtgaagctcacttcgcttacgcctgccagctctttcgacagcgatttcagttcgatctcttcgcctgcctgcagctgctcattacagtagctataaacctgctggcgcacgttctgtcgctctgctttatccagttgtgcttcggcagtgaaatcatcaaccgcttgcaacagcccacggttttgcgctttcgcgtttaacccttcgctggccccgaggaaatccataaagaaatccgccactttgcgccctactcgccctttcaggaaagtgagatagcgggtggactctggattggtttcccattcggttaaatcgatacgcgcaacaatatccgcatgattgatatcaagataatgggttgggttgatgtcgagattttcgttaacgcgcatactgctcaggttgctcagaactgccaccagcaaatactccaccgccagatagcgatagtggcaaaacagcacgaatccaccgtcagcaaaaggatatttcgctaattcgtcacgcaggcggccggttgccgcgcggctaaatgccaggaagtcctcttcgccctgacgctgtaagcgcagcgtctgcgccagttcactctcttcgctaaacaagccgtaagctttatttttggcgctatagacccgatgcagttctgccaccatctcaacgacggtttctgtcggttccagcaatgaatcgcgcaacaccagctcaaggttctgctcatcacgcttgataagctggtgcagagcaatctggttgatatccagactcatgataaactctcctttaagaccgggcggtattcaaccaccgccggttaagcgacgcaataaaagatggcggtcattttacagaaggcagcgtaacgagaatgatttaacgcataaaaaagcagaaaaaaaaccgttgctacggtaatatgttgccctttcatcaactaactgatttcgatttatgccacaaatttcccgctacagtgatgaacaggttgaacaattgctcgcagagctgctcaacgtactggaaaaacataaggctccgaccgacctttccctgatggtgttaggcaacatggtcactaaccttatcaacaccagcattgccccggcccaacgccaggcaattgccaactcttttgcccgcgccttacagtcctctatcaacgaagacaaagcgcactaagggaaacagataacaggttatggtaactcatcgtcagcgctaccgtgaaaaagtctcccagatggtcagttgggggcactggtttgcactgttcaatattctgctttcgctcgtcattggcagccgttacctgtttatcgccgactggccgacaacgcttgctggtcgcatttattcctacgtaagcattatcggccatttcagcttcctggtgttcgccacctacttgctgatcctcttcccgctgacctttatcgtcggctcccagaggctgatgaggtttttgtccgtcattctggcaacggcgggaatgacgctattactgatcgatagcgaagtctttactcgtttccatctccatcttaatcccatcgtctggcaactggttatcaacccagacgaaaatgagatggcgcgcgactggcagctgatgttcatcagcgtgccggttattttattgcttgaactggtgtttgcgacgtggagctggcaaaagctgcgcagcctgacgcgtcgtcgacgcttcgcgcgcccgctggccgcattcttatttatcgcctttatcgcctcgcatgtggtgtatatctgggccgatgccaacttctatcgcccgatcaccatgcagcgcgctaacctgccgctttcgtacccgatgacggcgcgacgttttcttgagaagcatggtctgcttgatgcgcaggagtatcaacgccgtcttattgagcaaggtaatccagacgccgtttccgttcagtatccgttaagcgaactgcgctatcgcgatatgggcaccgggcagaatgtgctgttgattactgtcgatggcctgaactactcacgcttcgagaagcagatgcctgcgctggcaggttttgctgagcaaaatatttcgttcacgcgccatatgagctccggcaacactacagacaacggcatctttggcctgttctatggcatctcgccgagctatatggacggcattctgtcgacccgtacgcctgcggcattaattactgcgcttaatcagcaaggctatcagctggggttattctcatcagatggctttaccagcccgctgtatcgccaggcattgttgtcagatttctcgatgccgagcgtacgcacccaatccgacgagcagaccgccacgcagtggatcaactggctgggacgctacgcacaagaagataaccgctggttctcgtgggtttctttcaatggtactaacattgacgacagcaatcagcaggcatttgcacggaaatatagccgggcggcaggcaatgtcgatgaccagatcaaccgcgtgctcaatgcactgcgtgattctggcaaactggacaatacggtggtgattatcactgccggtcggggtattccactgagcgaagaggaagaaacctttgactggtcccacggtcatctgcaggtgccattagtgattcactggccaggcacgccggcgcagcgtattaatgctctgactgatcataccgatctgatgacgacgctgatgcaacgcctgctacatgtcagcacacctgccagcgaatattcgcaaggtcaggatttgttcaaccctcaacgccgtcattactgggttaccgcagcggataacgatacgctggcaattaccaccccgaaaaagacgctggtactgaacaataacggtaaataccgcacttacaacttacgtggtgaaagagtgaaagatgaaaaaccacagttaagtttgttattgcaagtgctgacagacgagaagcgttttatcgctaactgattaattataaatcagttagcgaaatatcttacttgcaatcggtgtggaaaacggtagtattagcagccacgagtcggcacgtagcgcagcctggtagcgcaccgtcatggggtgtcgggggtcggaggttcaaatcctctcgtgccgaccaaaaatcccaagaaaaaaccaacccttacggttggtttttttatatctgcaattaattcgataaacagaccgtgacacatcacagcctgtttattttctgttatcagaacgtccagaccacacccgcctgagtattccacggcgattctacccctgcgccattgccatagctgactgacaaatgaccgcttaacgtcggggtaaacgatgaccttataccagcctgataaacgccactggttccagccacatcattattaaatttgccatcgtcattaactttcacctggttagaatcggcgtattcctgacgcacggccgctttcagccagggttccagcgtcgtaccgttttgcaggtccatgtgatagcttaccgccgttcccgcttcagcgcgtaatatccgggtatttcccacatccgcgcgcatgccgtttgataacgtgtagtcctgaccatctgtggtaaagccggtaaaggccagatagggtctaacactccacaatccgtcaacccaacggaacccgctctcaacatgagcacccgcgccgttactattgtaatcgccaaacgctgttgccccattactcatcttgccatggatggtgttggcaaaacggtcaactttcaccaccccatcaacataggcaccgttctgatgctcccaaccggcataagcccccagggtatagctatcgatattacctttgccgccgcgatcaaaaccaatatcagaatgagagtaaccaaagatcaagccgcgaattgtactgctttcttcacgggagaaacggctatcgataccgagcgtcaggcccgtcaatgtttgctcaaaaccagctcccgcatcagtggtcacgttgttgcgggtgttaattgccgaactccacatcgccgtatcgtaactaacgccttttacgctaccaagacgctcacgcacggtgtccagttctgcatcaaataccagcggttgtgcggccgccatattcagcacatcagtggttgaaggggtaatttgcgcgcgattctctgccagactccagctatggttgccattatccagcaaggtatattcatacgtaccgatatcaacaacgcctccggcattgcccaacgtaaatgcagcatcaccgccgcccgttgttaccagtgtaaggctatctcctgctgccgggctggcaccggtgtccgtcacgaatattttgaaatcacctgttgcctgaccggtgacgttgagctgatcgctctgatgattagccatatcggtacgcatataaaaattgccgtttcccgacagggtattggtggtcaacgtaatgaaattttccgcacttgccgtcactgatgaacgagtcactggctcatccatcataatcacatttgcgtcagacatcgcaaggttggctaagttgaggagggtgttttggttcgtcgtagtgatatcggcaatgatggtccatacgctattttcgagcgaaacgtccgctttgctggtatccacggcaccatgcgttctaaaagaagcgccctcagaaaccactaccttacccaccaacattgcgggtgcataatttatttgcggcttcatgacctcaagaatgccatcattccctctgactgaaacgttaaccattgtgccagcccagacgttagcgcggccattgttgataaccatattttcagagatggcttttgaggaatacgtgatacttccattctgatatgatcgaccgagatcatataccgcatttgcctgcactttcgtaccagtatcctttcccagcgattgcatagtggcatgcttatcaaggatagtatcaatggcctgcgtgtcctccataacaatgagcccggaaccatcatccagttcataattttttgacacaccatcttttatactaaattggcctttactgtttggaccactcacttccagcgcattcgttgagacaattaattttccgcctgcttttttatcaacgccagttacagtcccgccatccataacctccagtaagccgccactatctacagtggtattataagcgaagtcattttcttcaactcgcaaacttccgccgttttccaacaacatattattagcaataccattcttgatatcgaactgaccgagacggtttgttccgaatacctccatggcccgcgtggttgttttaatagcaccgcctgctttctgatctaccgcaaatgcaaatcccccctctttaacctccagtagtcctcccttttcgatagcgacaaagacggcccccccatctttttcaacgattaagcgcccgcctttaatcgtggtatcattcgctgcgccataaacctgtagcacaccattattgagcgtagtctggtttgccgcgccacccatttgaacaatttgataaccgtcatttaatactgagtattctgcggcgccattcatttcaatgtactgataccctccgttaatttcagtattattacttacaccaaattcttttatatgctgttctccgccaggattgattttcgtattattggcggtcccataaaccagctggatatctttttccaggacaacaccatcaactgtctcaccatactcaacagttgatgccaatgctatgggtgaatataaggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccataacgctgtagccaccagaacagatattgcggaacgacaaagagaaacagaaccagattgatgcattgagctttcatcctatgaaattaattgctgttaaaagcattgggtacagaaaatacccatagctccatacccggagtcagtttttaaaaactgtttaaagaaatgcacaagtattgtgattgattttttagttgtttttcttgatgagaagctgatgcaaaattccgtctttataatgaaaatgatgccaaagcgaacgacaaggttgtagttttcactacatgtccatacataaaatggggtaacattcacgcgcctggtagcgttaccaacgctacgctcaaacataatgattctaataaaacctcaggagactactatgcctgaagcaacaccttttcaggtgatgattgtggatgatcatccacttatgcgacgcggtgttcgtcagttactggagcttgatcctggctctgaagtggtcgccgaagcgggcgacggcgcgagcgctatcgatctggcgaatagactggatatcgacgtgatcttgctggatctcaatatgaaaggtatgagtggcctggatactctcaatgccttgcgcagggatggcgttaccgcgcaaattattatcctgaccgtatccgatgcctccagcgatgtctttgcgctgatagacgcaggcgcagacggttatctgttgaaagacagcgacccggaagtattgctggaagcgattcgtgccggagcgaaaggcagcaaagtctttagcgaacgcgtcaatcagtacttacgtgaacgtgaaatgtttggcgcggaagaagatcccttcagcgtgctgacggagcgcgagctggatgttctgcacgagctggcacaggggctgtcaaataaacagattgcctcggtgttgaatatttccgagcagacagtaaaagtacatattcgcaatctgctgcgtaaactcaatgtccgctcacgcgtggcggccaccattctgttcctgcaacaacgcggggcacaataaaaatagcccgatggatttatcatcgggctgagatttatgacaaacgcaaaactgcctgatgcgctacgcttatcaggcctacgtggatcgatcaatttattgaatttacacaattttgtaggccggataaggcgttcacgccgcatccggcataaactaagcgcactttgtcaacagtctagcccgatggcatcaccatcgggcctctttttatttactctcctgcggcgacaaatgttgcatcgcctgcgcgatactacgttcaatcaccgcacggcgagtatcgttggcaggtaagagtttcaacatcatctcccacgcggcaacggcttcgccaaatcgctgctgctcaaaggcattaaacgcatacatgcttagcacacggatattgctatggtccgttctcaccagctgacgtagcagttcaccgccgaggcggttgtcgttgggatcagatgaacgagtcaacgcttcagcgtatcccagtgcagcatcactgtttttcggatcgaggcgatacgcagtggcgtatgcatcggtggcgatactggcgttacccagcgccatgccaacgcggcccaacataatccagccttctatatctcccggatttttttgcagttgagtacgcatccccagcgcaagacgcgacatctcttcttcgttgagcggatcggctttcggatccagcgccctgtccagcaacgccggagcctgtgccgtggcctgctgccagattttcacctgctgataattgccagtctggtagtagctgacgccagccacaattaacgccaccacaatacccggcagataaacaacatatccggcacgcttaccttccggcacgctttgttcaggaaacgcttccggcaccacgcgtacccgacgccgcgagcgggcgtatatgacccaaccgccaatgccaatagccactactggcagcacccacagcagcacggtcagcggcgttaacggcggatcgtaagtgacgaagttgccgtaacgcgccaccatataatcgacaatctcttttttacttttaccttcctgcatcagttcatacactttctgacgcaggtcggtggcaatcatcgagttggaatcggcaatgctgttgttctggcatttcgggcagcgcagttcttcagtgagctgacggaactgttgttcctgtgcttcatctttaaactgcaacacatcgatggtcgccagcgctgagccggagatcatcagcatcagcacgcccaataaaaacctcattgtgcggcctccttactgtatttctcccacagcggcttgatctcttcttcccagacgcgaggattcagatcgcccgcatggcgatagcgaatgatgccgttgccgtcaataagaaacgtttctggcgcgccatagacaccgagatccagccctaacatgccatcgccatcaaacaggcttagcgcgtaaggattgcccagctctttcagccagctgattgccttctggcgatcgtctttatagttcatgccgaccacgcggatgccctgcgcagaaagctgattcagatattgatgttccgcacggcaggtcggacaccaggtcgcccagacgttaagcagtactggtttgccctgagtcagcacatccgcctgataaaactgccccggattgtccagtgattcgagacgaaacttcggcacaggcttgccaatgagcgccgattccagattggtcggatcatccccttcggcattacgcgccagctgccacagcagcgccgcggcaatcgccaggaagataatcaacggaattaacaatactttgcgcttcatacggcctccggcgcagttttttgcggactcacgcgcttacgatagcgaggatcaaacagacacagcagtccgcccaacgccatcatcagcccgcccgcccaaatccagcgaacaaatggtttgtagtaaagacgcacggcccacgcgccgttttccagctcttcaccgagggccgcgtacaggtcacgcgtgatgccgccgtcaattgccgcttcggtcatcatcgacccggcagtgttgtaataacgtttttccgcatacagcaccgtttccggcttgccatcgcgcgttacgccgatagtcgccacaccgccacgccagttcgggccagtcacctctttgacatcacggaaggtgaagcgatattcatgaatatcgacgctatcgccggacttcatgcgcacatcacgctcaacgctatagttctggctaaaggcaatgccaacaattgtcactgccagcccaaggtgagccgccaccatcccccaataactgaaggtggttttcgtgccgcgtgaaatacgtagcgcagcttccgcaattgccagcaccgcaatccagcaggccattgccaggccgagcaccgtcatcgccacaactttgctttcgaacagccacggcaacagcagcgacagcaccagcgtagagatgaaggcgataatcaataaattgcggatcttacgcgggcgatcccgcccccagcgcaccagaggaccgacaccaagcagtagcgcaaacggcaccatcagccaggtaaacatggtgttgaagaacggttcgccaatcgaaatactgcccagtcccagttgcttatgcaccaacggcagcagcgtccccagcaacaccaccagcatcgcagcgaccagcaaaacattgttcgctaacagcaaagattcccgcgaccacagcgcattgtttacgcgtgagcgaactttgtgtccacgcgcggcaaacagcagcagcgaaccgccaatcaccagcaccataaaggcgaggataaacataccgcgcgccggatcagacgcaaacgcgtgtaccgataccagcacgccggaacgcacgaggaaagtccccaacagacacaacgagaaggcactgattgccagcagtaatgtccacgctttgaagctggcgcgttgttcagtgaccgccagtgagtgcatcagcgcagtccccaccagccacggcataaacgaggcgttttctaccggatcccagaaccaccagccaccccagccgagttcgtaataggcccatgcggaaccgagcacgatgccgagcgtcaggaagatccacgctgccagcgtccacggacgagtaaaacgcgcataagtgctgtccagacgcccgctcagcaaagaagcaatggcaaaagcaaacgccaccgagaaacccacgtaccccatataaagcagaggcggatggaagatcagccccggatcctgcaatagcgggttaagatcgcgaccttcaatcgggaagttcggcaacgtgcgagagaacgggttagaggtaaagagaatgaacagcaaaaagccgacactgaccatccccattatcgccagtacacgggccacaatatccagcggaatacgctgactaaaaatcgccaccgcaaaggtccagccgctcatcagcagcacccacagcagtagcgagccttcatgcgcgccccaggtagccgccacgcgataccacaccggaagctgggtattggagttgctggcaacataggtgacggtgaagtcgttgaccacgaaagcattgaccagcaccagaaatgcgccagccacagacataaacagcagccaggcaaacaagcgggaagacgccatcatgcgcgcatctccgcgcgccacgccccatagcggatacacggacagcagcagcgcaattcccagcgccaggcacagcagtccgttaccaatttctggcatcatgatgctgggtccttataaacactcgccgggcgacggtggttagcttccatcgctttctcaacttctggcggcgtatagttttcatcgtgtttcgccagcacttctttcgcgaggatatgattgcctttttccagttcgccctgcaccacaacgccctgcccttcacggaacagatccggcaaaatgccttcgtaagagacatccactgagccttcagcatcgtaaatggtgaaggtcactttcagcgaattgggatcgcgctgcacactacccggcatcaccatcccgccaacgcgcagacgctgaccgacttccggcatttgctgagtttcacgcttgccgtagagaatttcccccggcgtataaaagagatcgatattcgagcgcagcgcatatagcaccagaccgatagtcagcgccagccctgccaacacggcacaggcaatccacaagcggtttttacggcgaatattcatgcagcctcctgctgttgcgcagcacgtaaacgcgcctcacgcgcccgctgttgcgccacgccacgcagaattgcgcgatgttgcatcaccgagtgcacgaccaaaaccaccagcggaataacggtcatcaccaccgccagccagacaaaaaaggcgtaaccgcccattgcgaaaaattcattccaggaagcaaatgcaggggtcatttacggcctcttttcagtatcagttcactcacccacggacggcgtttttccatcagcaaaatcaaattacgcatccgcatcagcgtcagcgtggcagacaggagcaggaagccaaaaatcgaccagcgcagcggcgaacgcatcgccggatcgatactttgctgcatccgcgttgatccctgatgcagggtgttccaccactccacggagtaatgaataatcggcagattcaccacgccaatcagcaccaggatacctgccgcacggcccgccagacggcggtcgtcgaaggcgtgccacagggcaatcacacccacatacaaaaacagcagcaccagttcagaagtcagacgtgcatcccatacccaccaggtgccccacatcggttttccccatgcagagccggtaaccagggcaataaaggtaaacacggcaccaatgggggccatcgccgccaccgccaggttggccattttcatctgccagacaaggccaataaacgctgccactgccattgatgcataaatgcccatcgaccagatcgccgcaggcacatgcaggtagataatgcggtagctatttccctgctgataatcagccggagcaaagccgaatccccagatccagccgacggtaagcacgaccacactggcaattgccagccacggtataaaccagccacagatttgatacagccgtggtgggatcgccagttgatgcagtgttttccacatagtttcgataccagactcgaacaaaaatcagtaatccagcgttattgaatgctgattcgtaacgctgccgccgtcgcaaaaggacttaatgtcgcggtgcctgccagcaacgcgcctaaaattgccagatacccgtcaacgggcaaatgcatagaagccgcgtccatcgcggcggtggcaaagatgagtaatgggatagtcagcggtaacaccagtatgctgagcagcacaccaccgcgcttaagtcccactgtcagcgccacgcccggtgcaccgagaaagccaagcgtaggcgttcccagcagcagcgtcagcgccatcacttgccagccataaacatccattcccagtagcattgctaccagtggcgaaaggatgagtaacggcagaccggttaccatccagtgcgccatcaccttcgccagcacaacggcgggcaagggtaacggcaacaacatcaattgttcaagactgccgtcctgcaaatcgtcacggaacagtcgttccagcgccagcaaggatgaaagcagcgcagcaacccagataatgcccggtgcaatacgcgccagcagttgcggctccggaccgatactgagcggaaaaagggtaattacaatcaggaagaaccacagcgggttggcgatttcggcgctatggcgaaacgctacacgcagctcaagacggaaaatgcgccagaacatcatgcggccctcgtttgcgtcagtgaaatgcggcgaattttactttcagcaacgttgagcggctggtgggtagtcagaatcacaatccccccctgctccgtatgctgcgccatacgctgggtcagacgatcgacaccgttaacgtcaatcgcggtaaaaggctcgtcgaggatccataacgtggcacgggtcagccacagacgcgctaaagcgacgcggcgttgttgcccggccgagagctgatttacaggaatatcttcgaatccggcaagcccggcctgcgccagggcttccagacattgtgcggtatcgccatcgcgatgataaaagtgcagattttctaacgccgtcagccgggttttgatccccggctgatggcctatccataacaggttttgatggtagctgtcgcgtacctgatgcaagggctgcccttgccagagaacctcgcctgcgtcagggcgagacaaccccgtcagcaaacggagaagcgttgtcttccccgcgccgttgctaccggtgatttgtacccactctcctgcgttcagcgtaaatgacaagccactaaataaggttcgttcatcccgctcacaaagtaactctctggcttcaagcatacccacgcaataaccctgttaaaaacctggctcgacttcacgcatatcgggcagcttgtgcgctatccctttatggcaatcaatacaggtttgcccatctttcaccgcctggtcatgcatcttcgcggcaaccgatttctgggcggttgtatccatatactcgaagttgtgacagttacggcactcctgcgagttattgtccttcatgcgccgccactcattctgtgccatcgtcagacgatgagcttcaaatttctgcggcgtgtcaataacgccaaaaattttaccatacagctctttacttgctttgagcttgcgtatcatcttcggcacaaactcgtgcggaacgtgacaatccggacaggtcgcacggacgccgctacggttgttgtagtgcacggaatccatgtattcctgatacaccgtgttgcgcatttcgtggcagctaatgcagaactcttcggtattggctttttccatcccggtgttaaagccaccccagaagacgatgccgccaacaaaaccgatcaacagcagcgtccccagcgccagacggctgggggtacgccaccatttccacaggcgcttaatcagaccaggcttacggtcagaatttcccataataacctcttatttcccgtaaccttttgatggggtaaaggtattccccacgattggcgcggtatcggcctgcggtacgtgacattgcagacagaaataacgacgcggagccacttccgcgcccactttgccgtcgctgtccataaagtgagtaggactgatacgcggcgcgccagtggtgcgatagctttcgacaccgtggcactgcaagcagcgattggtattggtcgttacctgataaccttcaacgctatgcgggatcattggcggctgattcacatagttcagcggcatccgatcctgctcttttggcatccgaatggccccttcctgtgtcccggatacttccggcgactggctaaaatcgacgccattagccgcccaaaccgcgccgcttaccaccagggccagcatcgccgtccattgacacagcgctttcttcaggtcatggcttttcatgatttcgctcccgaactccatcgtgtagttattgtaaatacatcctcagaacagacatccacgcagcgaccgcacgtcatgcaatcgcggctggtgacctgcaccgggctttgttcatccagcaccggggcacgtagcacatgcggttccgggcaaacatgaaaacaatccatacagcggttacatttctgccgatcggtggccgcaacggtaatcacacctttgctacccagcacgccatacagcgcgccaaccggacaaatgtgcccgcaccagccgtgttcaacgaccagtagatcaaataaaaacagcgcgagaataagcagcgcgccgctgccgaagcccattaccaggctacgccccatcagagaaacggggttgatccattcccaaatgagcgtgccagttaaggctgatcccaccagaatgaccaccaacagcacgtagcgaatgtggcgagggatcgtcgcagactgattgaggtcaaagcgcctgcgtaaccagttcgctaagtcggtaatcgggttcagcgggcagacccagctgcaaaataatcgctttcccgccagggcgtagagcacggtgataatcaccgcaccggtcaacgccaccgtggcaggcagatgaccactggcaagactttgcagcgtcatcagcggatcggtcagcggaacggtgtcgaataacaggctactgctgtagttgccgtgcaagatccacacaccaaaccatggaccgctcaaaaacatccccagcacgaagaactgacaaaggcgacgtaacaccagccaacggtgactgcgccaccagccttttttctccagcgcctcgcgcccggcgtcacgtttacgatttgccattgttcccctccagccagccgaagcggtaatggtgacctaactcccctttcgccagtgacagcggtaacaccttgattgccggttgttccagcacgcatactttttcgcacttaccgcaaccggtacaggcgtcgctgtgaaccgtcggcagaaagcgggcgtgcttaccggtacgcgtgttgcgctccagctccagggtgatggcctcatcaattttcgggcattcgcgataacaaacatcgcagcgcagcccctgaaagttgagacagttttcctggtccaccagtaccgccagccccatccgcgcgtcgtcgatcgattcaatctcacgatccagcgcaccgcttgggcacactttggcgcacggaatgtcctcacacatttcgcaaggaatatcccgtgcgacaaaatatggcgtgcccgccgacagaccagaggccagcgtcgccagttttaaggtgtcgtaagggcaagcctgaacacactgaccgcaacgcacacaggcactggcaaaggcgttctcgtttatggctccgggcgggcgcaaccgcacgccagatgcgcgtgcggtttgctgttgtaaccccagcgccacacccacggcagccagcccgcctgctgtgcgaacgacatcgcgcagaaagcggcggcgaccattttgaggtttcgctgaccgggacataatggcttacaccttctccagtttgaccgcgcacttcttgaagtccgtctctttcgagagcggatcggtcgcatccagcgtcagtttgttaaccaactgtgcggcgtcgaagaacggcatgtacaccaggccctgtggcggacggttacgaccgcgcgtttcaacaatcgagatcacttcgccacggcgagaaaccactttcactttgtcgccacggcgcagatcgcgcgctttcgcatccagcgggtgaataaacaggaccgcttccgggaaggcgcggtgcagttctggtacacggcgagtcatactgccggtgtgccagtgctccagaacgcgtccggtagagagccacaggtcgtactcttcatccggtgcttccgccgccggttcgaatggcagtgcgaagatcaccgctttgccatccggtttaccgtagaacttatagccttcgcccgctttcacgtacgggtcgttaccttcgctgtaacgccactgcgtttctttaccgttcaccaccggccagcgcagaccgcgcgctttgtggtagtcatcgaacggtgccagatcgtgaccgtgaccgcgaccaaaccatgcgtactcttcgaacagccctttttgcagatagaagcccagctcgcgggattcatcgttcagctgatcttccgccagttcggataccgggaatttgctcacttccggtgtggcatacagcacttcgtacagcgttttgccacgcagttccggtttcttcgccagcagatcttccggccatacttcttcagttttgaagcggcgggagaactggactaactgccagagatccgatttcgcttcgcccggtgcctgtacctgttgacgccagaactgagtacggcgttcggcgttaccgtaagcgccctctttctctacccacattgcggtcggcaggatcaagtcggcggccagcgcactgactgtcggatacggatcggagacgatgatgaagttgcgcggatcgcgccagcccggcatacgctcttcattgatgttcggcccggcctgcatgttgttggtacacatggtccagtaaacattcagtttgccgtctttcagcgcacggtcttgtgccaccgcgtgcagaccgattttcgccggaatggtgccgctcgggatattccacttcttctcgcagatatcacggtgtttctcgttggtcaccaccatgtccgcaggcagacggtgagcaaaggtgcccacttcacgcgcagtaccacacgcagaaggttgcccggtcagggagaacggaccgcaacccggctgggaaattttgccggtcagcaggtgcaggttgtagaccaggttgttagcccacacgccacgagtatgctggttgaagcccatcgtccagtaggagatgactttcttgttcggatcggcatacagctgcgccagttgttctaactggtctttcggcacgccggtcatttcggcagttttttccagcgtatactcggcaacgaaggctttgtaatcttcaaagctcatcggttcggaggcgtcagaacccggattcttcgctgctttttccagcggatgggtcggacgtaaaccgtagccgatgtccgtcgcccctttgcgcaggttaacgtgcttgctgaagaagtcctgatttatcgcattgttttgaatgatatagttggcgatgtagttcaggatcaccaggtcagattgcggcgtaaagatgatgccgttatccgccagctcgaagctacgatgctggtaggtagaaagcaccgccacggtgacgttctggttagagagacgacggttagtgatgcgcgaccagaggatcgggtgcatttccgccatgtttgcgccccacagcacaaacgcgtcagcctgctcgatgtcgtcatagcagcccatcggctcatccataccaaaggtacgcataaagccaactactgccgacgccatacagtgacgcgcgttcgggtcgatgttgttcgaacggaagcccgctttaaacagcttggacgcggcataaccttcccagatagtccactgaccagaaccgaacataccgatcgattccggccctttttctttcagggcggttttgaatttctcttccatcacatcgaaggcctgatcccaggtgattggggtaaattcgccttctttgtcatatttaccgtttttcatacgcagcagcggctgcgtcaaacggtctttaccgtacatgattttgggcaggaaatagcccttaatgcagttcaggccacggttaaccggtgcgtccgggtcgccctgacaggccaccacacgtccctgctgcgttccgaccagaacgccgcaaccagtaccgcagaaacggcacggcgctttatcccatttgatggcttcctgctgaccaacaacggcgcgggcaacgcccggcacgctgagaccggcagccgccgcagcggccgcaacggcgttagctttcataaagctacgacgactgagtttcatggtgtttcctcaccttgctcttcctgctggtgataaaccagcgacaccgccagcacgccctctacgttgcgtactgactcaatggtttggatcagcgtttcgctgtcttctgcttccaccaccacaatcaactgaccgctcggcgcgtcgctgacagcaacttcacagccgggaaaggcgttcagttgggtgctgatgtctgaaattcgttcgcttttggcctgcacgaccaggctgcaaacttgccagttagtgtgcatggagatactccgcagttatggctgataccggacagctggctgcacatgctccacatccgttgcaaagttggctattaagttgcggctggtagatcccggagagcgtcgggcgaaagataattgccattggctcacagctatcctgacagcggcggcattcaactgactgatacgccaggcacgcgtccccgatggtgaactgcaaatcccaggccctggtgtggcgcggagaaaatagcgattcggggcaagcctgcgcgcaggcgtaacagaagctgcactcgttatttttgaaattaacgctcggatagccgcccgcgccgcgttgcagaatgttgttttcacaagcattaatacaggcgtcgcagcgggtgcaatgggtcagaaaatgagattcatcaccggaccagggcggacggataccgttactggctttgcgccagcgaccagtgagtatgccccgacgggatgcatcaatcttcacattgaccttccatcattaacgcgctctgaaaattgagagcgaccaaataaaccgcataattaataagccatttttatagccgctaagatattaaaggatgtgtcaaagatgcataccccgatcggggtaaaacctgtagcaggatcaaaagagtggcgggaagcgtggcaaaaacgggcttttgctcacatttcaaatggttataaatatatttatatagcgattgattcaccagagatatttctgctggtttgctctctcattagaatttaacactaaaagagcaggtaaaattgtctgaatgttctttaagttattcataaagcaaattaataaatctgatgaatatgttaaccttcagcgacatcatcggtgaaaacctataaatgaagaaggaaagcaaaaaaatgaagaccattctacctgcagtattgtttgccgctttcgctaccacttccgcctgggcggcagaaagcgtccagccactggaaaaaatcgcgccttatccacaagctgaaaaagggatgaagcgtcaggtgattcagttaaccccgcaagaagatgaatctaccctgaaagtagaactgttaatcggtcagacgctggaagtcgattgcaatttgcatcgtctcggcgggaagctggaaaacaaaacgctggaaggctggggctatgattattatgtctttgataaagtcagttccccggtttcaacgatgatggcctgcccggatggcaagaaagagaagaaatttgtcaccgcgtatctgggcgatgctggaatgctgcgttacaacagcaagctgccgatcgtggtgtatacgccagacaatgtagatgtgaagtaccgcgtctggaaggcggaagagaaaattgacaacgcggtagttcgctaaactgccgtgaagtgcggcaccccgtaggtcagacaaggcggtcacgccgcatccgacatccaacgcccgagccggttgcctgatgcgacgctggcgcgtcttatcaggcctacaccgctgtgaagtgcggcaccccgtaggtcagacaaggcggtcacgccgcatccgacatccaacgcccgagccggttgcctgatgcgacgctggcgcgtcttatcaggcctacaccgctgtgaagtgctccaccccgtaggtcggataaggcggttacgccgcatccgacatctaacgcccaagccggttgcctgatgcgacgctggcgcgtcttatcaggcctacaccgctgtgaagtgctccaccccgtaggttggataaggcggttacgccgcatccgacatccaacgtccgagccggttgcctgatgcgacgctggcgcgtcttatcaggcctacaccgctgtgaagtgctccaccccgtaggtcggataaggcggttacgccgcatccgacatctaacgcccaagccggttgcctgatgcgacgctggcgcgtcttatcaggcctacaccgctgtgaagtgctccaccccgtaggttggataaggcggttacgccgcatccaacatctaacgcccgagccggttgcctgatgcgacgctggcgcgtcttatcagcatacgccacatccggcataccatgccggatgtggcgtatcattacaacgcaatatccgccacttctttttgaacgggttgcggtttcaactgcggtttcggcgtactatctgctgcctgcggcttgtcgtagttcaaccccagcacttcgctggtgtactgcaactcgcgttctgttgccgctacatcaccgttcagcttgcgtccataagacggaacgatcgctttcaacgtagcctgccattgcgggctggaaacacgatcgccaaatactttttccagcagattcaacataatcggcgcggcggttgacgcccctggcgatgcccccaggagcgcggcaatggttccttgctggtcactgacgacttcagtacccagacgcagtacgccacctttctcggcatcacgcttgataatctgcacgcgctgccccgcttgccacaaacgccagtcctcttttttcgcctgcggatagtactctttcaacgcttcaaaacgatcctcttcactcaacatcacctgactcaccagatatttcaccagatcgaaattatccagcccgacgtgcatcatcggcatcacgttagaggtggtggtggaactcattagatcccacaatgaaccgtttttgaggaatttggttgagaaggtggcaaatggcccaaacagcactacgcgtttaccgtccagaacgcgggtatcgatatgcggaaccgacatcggtggtgcgccaacggatgctttaccgtaaaccttcgccagatggtgattaaccacgtccgggttttccgaaacaaggaactgtccgcccaccgggaaaccggcgtagtctttcgcttccggaatccccgattcctgtaacagcttcagcgccgcaccgcccgcgccgataaagacaaatttggcacgaatgttctgtgcagtgccatttttcagatcggcaacggtaacggtccaggtgttatcgtcattacgctttagggcgcggacttcgctgctgagttgcagcgagaagttagatttcttctgcaaggaagcaattaactggcgggtgatctcgccgtagttcacatcggtaccaatttccgtacgcgtggctgccactttctgttgcggatcgcgcccttccatcactaacggtgcccactctttgatctgcgcgtgatcttcagagtaacgcataccgcgaaacagcgagctttgttgcaacgcggcgtaacgggcgcgcaggaaattgacgttatcctcgccccagacaaagctcatatgcggaacggtattgataaatgaacgcggagtacgcagcacgccgcgctcaacctggtgcgcccagaactggcgggaaatctgaaatgcttcgttaatggcgactgctttttcaatactgatgctgccatcggcgttttgcggggtgtagttcagttccatcagtgcagaatgcccggttccggcgttattccagccgttcgaactctcctgcgcgacaccctccaggcgctccaccatggtcatcgaccattcaggctccagctcgcgtaaataggtccccaacgtggcgctcataatgccgccgccaatcaacagtacatcagtttcctgctcctcggacgctttcgcttttgccgccatcgaaacggcattaagccccacggccatcgagaagagcatggcagtcacttttttcatcttgttaatgccttacttttagtcgctttattgcaggtgagatttgcgcggcatcaacggtaacacttaagtaacaacatttaaataatgtttataaattatattctaattttagaaacattataatttcgttgattaattatagggttattagaaatgaagggatttttagcatattgacctgacggcagcagtccgccaggtcagcgtcgtaatattatgccgtccgggcaacggcatcacgcgaagcggcatcgcgctcttcgcccgtcagctcgctaagttgcccattgcgcatttccagcaggcggtcggcgtggataaagtaatgatcatcatgactgatagcgaaaatagttttacccatctcctgcatcagcggcagcaacacctgataaaactcacgacggaagtgtggatcctgatccgccgcccattcatccagcaggataatatcgcgttcttctgccagcgccagcaacagcgccacgcgttttttctgcccttttgataacttcaggttaacaatacgcccgttgcttaactcaagcttatgagccattttcagctgcgccagccacttctcaaccagttgcgggttagcgggtttaccctccggccccagcagttgatcaaacagccagacatcggtaaacactgccgaaaacagtttgcgataatcttccggttgttcgccgctgacaggtttgccatccagcaagatttcgccgctttgtggctgatacaagcccgtcaacaacatcgccagcgtcgattttccgctaccgttgccgccaatcagaaacagcagctcgccacgtttgatggtgagattaatcggaccaacggaaaacgcgttatcctgataagcaaacgtcacgttacgcagctccagcgtttgccagttgggaaacgcctgcgggcgcggaaactctgctttgaaaggcgcgagcgcgaatttgttcagcttgttaaacgccacctgcgccgtcagcagcgtcggcaatgcgccaaccgccgaaagcagcggcgtacgcaggaataaaagcgtcaacgaataggtcgcggcaacgttggtatcagcccaaccgaggctgttcgccatccagaacaccaggccgattgcgcccagcatcatgatgtttgaccagttcacggcactaagatggaaggtgtctgcgcgaataatatggtggcgatactcttgcgcatcaggaatgtagaggttgttaaacacatactcggcgcgttcccggttcagagtcagctctttgcgcccttcaagtacagtttgaaaatccgtgtacagcttgtcttcggtttcacgcagggtcgccatatgtttgtacacccgcgccaccagcacaaaaccgccccagatggtgatcgccatccagatagccgttaccagcaacattttgcccgacagcatccacagatacgccgctgaaccgatagtgagaatgatcccctgcaccagttccggcagacgcacaaaagcaatggtgatattgcgcacatcgctggttaaccccgccagcaacgaggcgctaccgagttgttcaatgcgctcgacgtgagtatccagaatccgcttgataaattcactacgcagtcggtaaacgaagtgatgccccaaagtggtgagcgccagttgcgatccgagagtgactgccatcaacagcagcaataatcccagaaactccggcaacaccagcagactggtatccgccgtttcgataaggcgctgattgataaaagcaattaagccaatgcctaatgccgcactggcgaggcttagcgccatcacactgataaatggccagcgatactgccgccagacaagtacaagaagttccatgcagaaaacccggacaatgaattacagcccgcagtttaaacatcttcgcgcgcacagcaataataattcttatttttattcttttttacctgcctgacggaatgtcaggttgtagcggcagtcgatggtgagtggatgaaaccccgctttcaacggttgaataccgtgataaaacagccgcgattcaccgccccataccaccacatcgccatgttccaacaacaaacgtttgagcggatcatttcgtttcaggccgccaaattgaaaaatcgcgggtaagcccagagaaacagaaacaattggcgcgcgcagatccggttcgtctttatcctgatgcagcgacagtttcgcgccaggagcgtagcggttgataagacaagcatctggctggaaatctggatagcccgccgccgtagccgcacgttgacataaattatgaaaactctgtggcatggcgggccacggtttatttgtttgcggatcaatgggcgaatagagataaccttgccgatgggtcgtccagcccagatgcccacagttggtcatcgccaccgacatggtatatcccccgggggtgaccatctggcgaaacggcgactggctggcaacgtcattaatatcgcggatcagttgctccgcagcgttaaaagcaaaacgccgtaaaattaccgcaccagccgccagtggctcttgccacggttcagcatcggcaaacagatccaacattacctctcctcattttcagcttcgcggcgcagcagttgcgctttacgcgacacgccccagcggtaaccggaaagtgtgccatcaccacggaccacccgatgacagggtattatgatagccagcttgttggcggcacaggcgctggcaacggcccgtaccgctttcggtttgccgatggcgttagccagttgctgataactgacggtttcaccgcaaggtatcgtgcgcagtgcctgccagacttgttgctgaaaagcagtgccgcgaatgtccagcggtaacgtcagcggcgtatcgcgttgattgaggctggcgatcacttcacgcacatgttgctgaaacatcagatcggcaggcgcgttgtcggcagcgggaaacatctgctgcaactcgctgattagtgtcgcgtcatcatcgcccagcaatatcgcgcaaatcccccgctcgctttctgccaccaggcaacgacccagctcacaatcagccagcgcgtaacgcaccgccagattttcgccaccgtgacggaattgtttagccgtcatgcccagcgtttcgtcagctttgcgatagtaactgctgctgtcggggaatccggcgttaagaatagacgtcgtcacgctctcccctttcgccagcgattcgcgcaaacggcgagcgcgccaggcctgttgccaggctttaggcgtcattccggtagtcgctttaaacaaccgatgtagatgaaatggactcatcgccacctggtcggctaaggcttccagcgttacaggcgtttcctgttccagcagtcgacacgcgtgggtgattttatccaaccgatgttgctgggcattggctttttctggctgacaacgtttgcaggggcgaaagccagcggcgagtgcctcgctggcatttgcgtagaaggagacgttttcccgcaaagcatgtctggcgcggcaagacggacggcaaaagatgcctgtggtacgcacggcgaaaacgaattcgccgtcggcattcgggtcgcgggctaagacagattgccagcgttgatcgtcagttaagcatgtggcttttttcataatcagctccctggttaaggatagcctttaggctgcccggtcaccatcacgcaaaaaccaacaatcttgcgctttaatttttttcgctgacaaggaagcttttaaactgtggtgacatccaggttttaaagctatcgccttctttggtgatcatataaaccgccagcccttcccggcgaacaacctctttagctttctccggcccgagtaccatcaagccagtatcccaggcatcggcttccagcgccgtcggagcaatcaccgtcacggataccagattgtgttcgatgggacgcccggtttgcggatcgataacatgggaaagacgtttgccgtccagttcgtaatagttacggtagctgccagaggtgctaatcccatgaccgttgatatccaccacagcctgaaccgcgttttctttatcggttggtttttgaatcgctacccgccacggcaggccttcaccgttcataccacggctgttcagcgcgccgcccaccgacaccagatagcgggaaatcccttcctgctccatcaagcgtgccaaatgatcggccgcatagccttcgccgacggtggagagatcgacatataaatccggcaggtctttttgcagatattgctgatgcgactgattgatgaccgtcaggtgctgtaagccggttttggctttcatcgcatcgatctgttcctggctcggaatttgaaccggctgttgttccgggccaaagccccacagattcaccagcggcccgacggttatatccatcgcgccatcggtcttcgcgccaatgcgcagcgaggtggtgacgatatcggccatcgcttcacttaccggccacggcgataaactttgcgagtcgttaaagcgcatcagcgcggaatcttttttataggtcgaaagcagctgatcgtcggcgtccagttgggtctgaatcttttctttaagttcggcgctgcgtttggcgtcaatgcccgggatgctggcacgccagaaggtacccatagttttgccttcaagaacggtaacttcagtagcgtgggttttggcgggttgtggtttttgatcgcaaccaacaaagaagagcgcggcagccagcagtgccacgcgggtaaagcttatttccatacgtgattatcctcatgcgaacggtcgcaagagtacaccaaaaaactgagtttgtacgctgaaaacaatgaaaaaagggcccgcaggccctttgttcgatatcaatcgagattagaactggtaaaccagacccagagctacgatgttatcagtgttgatgccagcgtcacgagtgaactggttgtcgtccagcaggttgattttgtagtcaacgtaggtggacatgtttttgttgaagtagtaggtagcaccaacatcaacatatttcaggatatcttcgtcgtcgtagccacgacccaggtttttacctttagactgcaggtaagccagggacggacgcagaccgaagtcgaactggtactgagcaacagcttcgaagttctgtgctttgttcgcccaacccagggaacctacgcgagttgcgttgtaggtctgggtgtactgagcagccaggtagatgttgttagcgtcgtatttcagaccaccagtgtaggtttcagcacggtcgccgttaccgatgtaagcagcggtgttctgagcatcagtacgtttggagctggagatcgcaccaccgataccgaaaccttcgtaatcataagtgatagaaccgccgacgccgtcgccgttttgacgcagtgcgtcacgaccgttgttagttacgccactagtaaagccttcaccagatgggttgccgtttttaccctggtactgaacagcaaagttcaggccgtcaaccagaccgaagaagtcagtgttacggtaggtcgcgaagccgttaccacgctgctgcatgaagttgtcagaaccgtaggtgtcaccaccgaattctggcagtacgtcggtccaggaagttacgtcataaacaacgccgtagttacgaccgtagtcgaaagaacccacatcctggaatttcagacctgcgaatgccacacgggtccaggagttgttttcgttttcagcgctgttgccctggatctgatattcccactggccgtaaccggtcagctggtcagtaacctgagtttcacctttgaagccaagacgcatgtaggtctggtcgccatctacatctttgttgtcagagaaatagtgcaggccgtctactttaccgtacagatctaatttgttgccgtctttgttgtaaacttcagcagcgtttgctgcgcctgctaccagcagagctgggaccaggagggacagtactttaactttcatgttattaaccctctgttatatgcctttatttgcttttttatgccactgcatactgattaaccctcattaatcagtcggcaagtccattctccccaaaaatgcagaataatccaacacgaatatgatactaaaacttttaagatgtttcatttatcgctatagatgtttcaaaatgtaaatgcaagggaactttttaagattattgcggaatggcgaaataagcacctaacatcaagcaataataattcaaggttaaaatcaataacttattcttaagtatttgacagcactgaatgtcaaaacaaaaccttcactcgcaactagaataactcccgctatcatcattaactttatttattaccgtcattcatttctgaatgtctgtttacccctatttcaaccggatgcctcgcattcggttttttttacccttctttacacacttttcattattctgtgctaccacagaaaaactataacgcttgttaactatttcacaaataattaacatccgcataatttccagcaatctttgtttatttgcaattatttttgttgggctttttgtaggttatttgtacagcaaaatggcgcttgtacatctatttcccccaatgcaggatgataaatatcacgggagaatagagaatcatcaatcaggtaagagtctggaatttcacactgtaccctttatactgccctatcacttcgcgaagttttaacaggtcataaacacgaatgcgtcagaaagagacaacggccacgacccgcttttcactcctaccggggagcattacccgcttctttttactgttgatcattgtgttactggtgacgatgggtgtaatggtacaaagcgccgttaacgcctggctgaaagataaaagttaccagattgtcgacattacccatgctatccaaaagcgcgtcgataactggcgttacgtgacctggcagatctacgacaacattgccgcgacgacctccccctcctccggcgaaggtttacaagagacgcgcctgaaacaggatgtctactatctggagaaaccacgccgcaaaacggaagcgttaatctttggctctcacgacaactcaacgcttgagatgactcagcggatgtccacttatctggatacattgtggggcgcagaaaatgtaccgtggtcgatgtattacctgaatggtcaggataacagtctggtgctgatctcaaccctaccccttaaagatctcacctccggatttaaagaatcgaccgtcagcgacattgttgattcacgtcgtgcagagatgttgcaacaggccaacgccctcgatgaacgcgaaagcttttctaacatgcgccgcctggcctggcagaacggtcattactttacattgcgtactacctttaaccagccaggacatctggcaacggtcgtggcttttgatctgccgattaatgatttgatcccaccgggtatgccgctggacagtttccgccttgagccagacgcgacggcaacgggaaacaatgataatgagaaagaagggacggatagcgtcagtatccactttaacagtacgaagattgaaatctcctcggcactcaactctaccgatatgcgcctggtctggcaggttccttatggcaccttattgctggatacgttgcaaaacattctgctgccactgctgctgaacatcggtttgctggcgctggcgttatttggctataccacattccgccatttctccagccgcagtacagaaaacgtccccagcacggcggtcaataacgaattgcgcattttacgggcaatcaatgaagagatagtctcactgctgccgctcggcctgctggttcacgatcaggaatcgaaccgcactgtcataagtaacaaaattgccgatcatttgctgccgcatttgaatctgcaaaacatcaccaccatggcggaacagcatcaggggattattcaggcgacgatcaataacgagctgtatgagatccgcatgttccgcagccaggtcgcgccgcgcacacaaattttcattattcgcgatcaggatcgcgaagtgctggtaaacaagaaactcaagcaggcgcagcgtctgtatgagaaaaaccagcaggggcggatgatctttatgaaaaacattggcgatgcgctgaaagaacccgcacagtccctggcggagagcgcggctaaactcaacgccccggaaagcaaacaactggcgaatcaggcagatgtgctggtgcggctggttgatgaaatacagttagcgaacatgcttgcggatgatagctggaaaagtgagacggtgctgttctccgtgcaggatttaattgatgaagttgtgccttcagtgttgcctgccatcaagcgtaaaggtctgcaactgctgattaacaatcatctgaaagcacacgatatgcgccgcggcgatcgcgatgccttacgacgtattttgctgctactgatgcaatatgccgtgacctcaacgcaattgggaaaaatcacccttgaggttgatcaggatgagtcctccgaagaccgcctgacgttccgcattctggacacgggagaaggcgtaagtattcatgaaatggataatttgcacttcccgtttatcaaccagacccaaaacgatcgctatggcaaggcggacccgctggcattctggctgagcgatcaactggcacgtaaactgggcggtcatttaaacatcaaaacgcgggatgggcttggtacacgctactctgtgcatatcaaaatgctcgcagctgacccggaagttgaagaggaagaagagcgtttactggatgatgtctgcgtaatggtggatgttacttcggcagaaattcggaatattgtcactcgccagttagaaaattggggtgcaacctgtatcacacccgatgaaagattaattagtcaagattatgatatctttttaacggataatccgtctaatcttactgcctctggcttgcttttaagcgatgatgagtctggcgtacgggaaattgggcctggtcaattgtgcgtcaacttcaatatgagcaacgctatgcaggaagcggtcttacaattaattgaagtgcaactggcgcaggaagaggtgacagaatcgcctctgggcggagatgaaaatgcgcaactccatgccagcggctattatgcgctctttgtagacacagtaccggatgatgttaagaggctgtatactgaagcagcaaccagtgactttgctgcgttagcccaaacggctcatcgtcttaaaggcgtatttgccatgctaaatctggtacccggcaagcagttatgtgaaacgctggaacatctgattcgtgagaaggatgttccaggaatagaaaaatacatcagcgacattgacagttatgtcaagagcttgctgtagcaaggtagcctattacatgaacaatatgaacgtaattattgccgatgaccatccgatagtcttgttcggtattcgcaaatcacttgagcaaattgagtgggtgaatgttgtcggcgaatttgaagactctacagcactgatcaacaacctgccgaaactggatgcgcatgtgttgattaccgatctctccatgcctggcgataagtacggcgatggcattaccttaatcaagtacatcaagcgccatttcccaagcctgtcgatcattgttctgactatgaacaacaacccggcgattcttagtgcggtattggatctggatatcgaagggatcgtgctgaaacaaggtgcaccgaccgatctgccgaaagctctcgccgcgctgcagaaagggaagaaatttaccccggaaagcgtttctcgcctgttggaaaaaatcagtgctggtggttacggtgacaagcgtctctcgccaaaagagagtgaagttctgcgcctgtttgcggaaggcttcctggtgaccgagatcgctaaaaagctgaaccgcagtattaaaaccatcagtagccagaagaaatctgcgatgatgaagctgggtgtcgagaacgatatcgccctgctgaattatctctcttcagtgaccttaagtccggcagataaagactaatcacctgtaggccagataagacgcgttagtgtcttatctggcatttgcaccgattgccggatgcggcgtaaacgccttatccggcctacgattcccattatttcaacaaattacattaaagtaggccagataagacgcgtcagcgtcgcatctggcatttgcactgaatgccggatgcggcgtaaacgccttatccgtcctacgaatcccgcgatttcctgaccctctcggcatataacgtcagcgtctgttttatcacatccagcgttaccggcttcgacaggcagctgtccataccggactccagacaccgctgcttctcttcagccaacgcattagcagttactccgattaccggcaacgtcagtcccaactgacgaatgcgttgcgtcaagcggtaaccatccatatttggcatgttgacgtcgctaagcacgatatcaatatgattcttgctaagtacattaagcgcatcgacgccatcattcgcggttttacattgatagcccaacgatcccaactgatctgccagcaaacgccggttaatcggatgatcatccacgaccagaatcatcatatcgtcattatcgctgaccgctttgtccgttgacggcagagcgttagcaggatcgtcgctctccatctcgatcaaataaatacgcgccaacaatgccggtagctcatgcggagcagccacactgtgtacccactcccctggcgctttctccagcggaataccaatatggcgacgacagaaggtcactaccgctctgccctgccattttttactcactacctcgtcagtgatcaacacatcttcgggagtcggttcctgcccttcgtatgttgtaacgacgatgccgctgcgctgcaaactggtttccaggaactgacagagcgacgcattgcggaccgccagccagcagcgtttaccactcaacccttccacgccttttttctgcgggtactgagcgccgtacaacggaatacgcacggtaaactggctgcccattcccggttctgaatctaccgagatatcgccgtccatcatgctgatcagtttttcacaaatcgccagacccagaccggtcccctggaaattacgctgtacgcccgttccgacctggaagaagggatcaaacaagcgcaccacttctttcgccggtatccccacgccggtatcgcgaacacggatagagagataatcgccatccgcgcgaacatgcaaaactatacagccggtatcggtgaattttatggcgttactcaacaggttggagatgacctgctgtaaacgcatcgggtcgccatttaaggccactggcacatccggttcaataaagcagtacaagcctaactgcttgcgtaccaccagcggtaaatagttggcggtgatgtggttcatcacttcacgcggtgaaaactcacgcggttcgatcttcaactgttccgattcaatcttcgagaaatcgagaatatcgctgataattttcaacaacaggctggaagagttgttcattgccgtcaccagccgatcgacgcctttcggtaactctttggtttgcaacagatccaggttaccgataatgccatacagcggcgttcgcagctcatgactgacggtggcaaggaacatcgattttgactggctcgcctgttccgctgcttgtgccatctcctgcaacgactcttccatcttcacgcgcgaagaaacatccaccagcacacaaatggccacgttttcattacgatagcgcgaatggacgaagctgatttgcagattggtattgttgctggtcaggacatcaacaaaattgacctgctgcccacagataatttgcgtcagtcgttggcggtcctcatgcgtaagcatattgagataggtatgcgccagttcgttacttaaaatattgacgccatcagcggtacgcaaaatgcagatacccactggcgcggaggcgacaatcttgcgattgaactgctcatgttcttccagtcgcagggcgtcgctttccgccggaatgaaaatacgtcgctcgtacatccgtgcgagagtaaacaatgcagctccggcaagcacattcagcaaaattgcgttaaggatcaacatgcgaatgcgttccagcaccttatcaaccggcaccgaatacacgatgcttagcgatgagggtggcagatttttcttcagcaccagctcccggaacccttccgtatagccaaaccaggagcgttcctgcatccagcgaggatcgcccttaattttactttctggtccggtaagcgaaatcagggtatgaccattttcatcaagaatggtaacccccatcggcaacgtacccggtaagaaaaagttctccatccggatggtctgctcgacacccaaaagcgcctgcaaccggttcgccagataaactggcgtcaacgcgtaaaaatacccgacgccagggcgcggaccttcgctgatccagtagaggttactgccgctatcatcttgtggtgcatttcgatatttattgatgcgttcatgcaaagctttcaacgcggtatcgcgttccactggcatatcacgcagaccgaaattggccatgcagaggttatcgctgccgattaaaaatacccggtttagatcgtaagccgcagaaaaattatcgcgccagtagcgcataaaccacgccaatgactccagagaacctcgccaggtgttactcattgcggaacaatcggagtcggcaaacagcggttcaaacgcaggcacatccgcctgcgtttctcgtccacgcggggaaagcacaccgttttctgccgataagcgattttcggcgatgtacttcagctctttcatcacatcagaggtgcgttgaataaagcgctgagcctgatcggaactcagattaaattcctgacgaatttccgattctcgctgatgtaacgcattaacgatgtaaaaaacggatgaaaaagcaatcaacagccagagcactaacgccaatgctctgaacatgtagcgcgaggctttcagggttgtacgaaaagaagcaaggtatttcaaaggggcgaagctccgcctcaggtgaccgatggagtgtggttaaggtagcggtaaaagcgtgttaccgcaatgttctctcttctctggaatatgatacaccgccgagaaatcatcaccttaacctctgataatcgtcatataccggacaagactagtggatttcagcatgcattatatgaagtggatttatccacgccgcttacgcaatcaaatgatcctgatggcaatcctgatggtcattgtcccaacgcttactattggttatatcgtagaaacggaaggacgttcagcagtcttatctgaaaaagagaaaaaactttctgccgtggtcaacctgcttaatcaggcactaggcgatcgctatgatctctacatcgacttaccacgtgaggagcgtatccgcgcattaaatgcagaacttgcccccattaccgaaaatatcactcacgccttccctggcatcggtgctggttattacaacaaaatgctggatgcgataatcacctacgcgccttcagcgctatatcagaataatgtcggcgttaccattgccgcagatcaccctggtcgcgaagtgatgcgtacaaatacccctttagtttattcaggcaggcaggtgcgcggcgatattttgaattcaatgctccccattgagcgtaatggtgaaatcctcggctatatctgggccaatgaattaaccgaagatattcgccgccaggcctggaaaatggatgtgaggattatcattgtgctcaccgctggtttgctgataagcctgctgttgattgtccttttctcccgtcgcctgagcgccaatattgatatcatcaccgatggcctctcgactctggcacaaaatattcccactcgattaccacaattgcccggtgaaatggggcaaatcagtcagagtgttaataacctcgcccaggcactgcgtgaaacgcggacacttaacgatctgattattgaaaacgctgccgatggcgtcattgccattgaccgccagggtgatgtaaccaccatgaacccagcagcagaagttatcactggctatcaacgccatgaactggtagggcagccttactccatgttgttcgacaatactcagttctacagtccagtactggatacgctggaacatggcaccgaacatgtggcgctggagatcagttttccaggtcgtgaccgcaccattgaactcagtgtcactaccagtcgtattcataacacgcacggtgaaatgataggtgctttggtgattttctctgatttaactgcccgcaaagaaacccagcgccgcatggcgcaagcagaacgcctcgccacactgggtgagctgatggctggcgtcgcgcatgaagtacgtaatccgttaacggctattcgtggttatgtacagatcttgcgccaacaaaccagtgacccaatacatcaggaatatctgtccgtagtactcaaagaaatcgattcaattaacaaagttattcagcaattgctcgaattttcacgtccacgccacagtcaatggcaacaagtcagcctcaatgcattggttgaagaaactctggtactggtacaaaccgccggcgtacaagcgcgggtcgacttcataagcgaactggataatgaattaagcccgattaacgccgatcgtgaactgctcaaacaggtactactgaatatcctgatcaatgccgtccaggctatcagcgcacgagggaaaattcgcattcaaacctggcaatacagcgactcacaacaggccatttcgatagaggacaacggctgtggcattgatctctcgctgcaaaaaaagatcttcgatccctttttcaccaccaaagcctcaggaaccgggcttggtctggcgttaagtcaacgcatcattaatgcccatcagggtgatattcgcgtcgccagtttgccgggctacggcgcaaccttcacgcttattttaccgatcaacccgcagggaaatcagactgtatgactgctattaatcgcatccttattgtggatgatgaagataatgttcgccgtatgctgagcaccgcttttgcactacaaggattcgaaacacattgtgcgaacaacggacgcacagcattacacctgtttgccgatattcaccctgatgtggtgttgatggatatccgcatgccagagatggacggcatcaaggcactaaaggagatgcgcagccatgagacccggacacccgttattctgatgacggcctatgcggaagtggaaaccgccgtcgaagcgctacgctgcggagccttcgactatgttattaaaccgtttgatctcgatgagttgaatttaatcgttcagcgcgctttacaactccagtcaatgaaaaaagagatccgtcatctgcaccaggcactgagcaccagctggcaatgggggcacattctcaccaacagcccggcgatgatggacatctgcaaagacaccgccaaaattgccctttctcaggccagcgtcttgattagcggtgaaagcggcaccgggaaagagttgattgccagagcgattcactacaattcgcggcgggcaaaggggccgttcattaaagtcaactgcgcggcgctgccggaatcgttgctcgaaagtgaactgtttggtcatgaaaaaggtgcatttactggtgcacaaaccttgcgtcagggattatttgaacgagccaacgaaggtactctgctcctcgacgaaattggcgaaatgccgctggtactacaagccaaattactacgcattctacaggaacgggaatttgaacggattggcggccatcagaccataaaagttgatatccgcatcattgctgccaccaaccgcgacttgcaggcaatggtaaaagaaggcaccttccgtgaagatctcttttatcgccttaacgttattcatttaatactgccgcctctgcgcgatcgccgggaagatatttccctgttagctaatcactttttgcaaaaattcagtagtgagaatcagcgcgatattatcgacatcgatccgatggcaatgtcactgcttaccgcctggtcatggccgggaaatattcgagagctttccaacgttattgaacgcgccgtcgtgatgaattcaggcccgatcattttttctgaggatcttccgccacagattcgtcagccagtctgtaatgctggcgaggtaaaaacagcccctgtcggtgagcgtaatttaaaagaggaaattaaacgcgtcgaaaaacgcatcattatggaagtgctggaacaacaagaaggaaaccgaacccgcactgctttaatgctgggcatcagtcgccgtgcattgatgtataaactccaggaatacggtatcgatccggcggatgtataacaccaaaacttgctatgcagaaatttgcacagtgcgcaattttctgcatagccgctcattctccttataaatccccatccaatttatcccttcatattcaattagttaaataactaaatccaataatctcattctggcactccccttgctattgcctgactgtacccacaacggtgtatgcaagagggataaaaaatgaaaacaaaattgatgacattacaagacgccaccggcttctttcgtgacggcatgaccatcatggtgggcggatttatggggattggcactccatcccgcctggttgaagcattactggaatctggtgttcgcgacctgacattgatagccaatgataccgcgtttgttgataccggcatcggtccgctcatcgtcaatggtcgagtccgcaaagtgattgcttcacatatcggcaccaacccggaaacaggtcggcgcatgatatctggtgagatggacgtcgttctggtgccgcaaggtacgctaatcgagcaaattcgctgtggtggagctggacttggtggttttctcaccccaacgggtgtcggcaccgtcgtagaggaaggcaaacagacactgacactcgacggtaaaacctggctgctcgaacgcccactgcgcgccgacctggcgctaattcgcgctcatcgttgcgacacacttggcaacctgacctatcaacttagcgcccgcaactttaaccccctgatagcccttgcggctgatatcacgctggtagagccagatgaactggtcgaaaccggcgagctgcaacctgaccatattgtcacccctggtgccgttatcgaccacatcatcgtttcacaggagagcaaataatggatgcgaaacaacgtattgcgcgccgtgtggcgcaagagcttcgtgatggtgacatcgttaacttagggatcggtttacccacaatggtcgccaattatttaccggagggtattcatatcactctgcaatcggaaaacggcttcctcggtttaggcccggtcacgacagcgcatccagatctggtgaacgctggcgggcaaccgtgcggtgttttacccggtgcagccatgtttgatagcgccatgtcatttgcgctaatccgtggcggtcatattgatgcctgcgtgctcggcggtttgcaagtagacgaagaagcaaacctcgcgaactgggtagtgcctgggaaaatggtgcccggtatgggtggcgcgatggatctggtgaccgggtcgcgcaaagtgatcatcgccatggaacattgcgccaaagatggttcagcaaaaattttgcgccgctgcaccatgccactcactgcgcaacatgcggtgcatatgctggttactgaactggctgtctttcgttttattgacggcaaaatgtggctcaccgaaattgccgacgggtgtgatttagccaccgtgcgtgccaaaacagaagctcggtttgaagtcgccgccgatctgaatacgcaacggggtgatttatgattggtcgcatatcgcgttttatgacgcgttttgtcagccggtggcttcccgatccactgatctttgccatgttgctgacattgctaacattcgtgatcgcgctttggttaacaccacaaacgccgatcagcatggtgaaaatgtggggtgacggtttctggaacttgctggcgtttggtatgcagatggcgcttatcatcgttaccggtcatgcccttgccagctctgctccggtgaaaagtttgctgcgtactgccgcctccgccgcaaagacgcccgtacagggcgtcatgctggtcactttcttcggttcagtcgcttgtgtcatcaactggggatttggtttggttgtcggcgcaatgtttgcccgtgaagtcgcccggcgagtccccggttctgattatccgttgctcattgcctgcgcctacattggttttctcacctggggtggcggcttctctggatcaatgcctctgttggctgcaacaccgggcaacccggttgagcatatcgccgggctgatcccggtgggcgatactctgttcagtggttttaacattttcatcactgtggcgttgattgtggtgatgccatttatcacccgcatgatgatgccaaaaccgtctgacgtggtgagtatcgatccaaaactactcatggaagaggctgattttcaaaagcagctaccgaaagatgccccaccatccgagcgactggaagaaagccgcattctgacgttgatcatcggcgcactcggtatcgcttaccttgcgatgtacttcagcgaacatggcttcaacatcaccatcaataccgtcaacctgatgtttatgattgcgggtctgctgctacataaaacgccaatggcttatatgcgtgctatcagcgcggcagcacgcagtactgccggtattctggtgcaattccccttctacgctgggatccaactgatgatggagcattccggtctgggcggactcattaccgaattcttcatcaatgttgcgaacaaagacaccttcccggtaatgaccttttttagttctgcactgattaacttcgccgttccgtctggcggcggtcactgggttattcagggacctttcgtgatacccgcagcccaggcgctgggcgctgatctcggtaaatcggtaatggcgatcgcctacggcgagcaatggatgaacatggcacaaccattctgggcgctgccagcactggcaatcgccggactcggtgtccgcgacatcatgggctactgcatcactgccctgctcttctccggtgtcattttcgtcattggtttaacgctgttctgacggcacccctacaaacagaaggaatataaaatgaaaaattgtgtcatcgtcagtgcggtacgtactgctatcggtagttttaacggttcactcgcttccaccagcgccatcgacctgggggcgacagtaattaaagccgccattgaacgtgcaaaaatcgattcacaacacgttgatgaagtgattatgggtaacgtgttacaagccgggctggggcaaaatccggcgcgtcaggcactgttaaaaagcgggctggcagaaacggtgtgcggattcacggtcaataaagtatgtggttcgggtcttaaaagtgtggcgcttgccgcccaggccattcaggcaggtcaggcgcagagcattgtggcggggggtatggaaaatatgagtttagccccctacttactcgatgcaaaagcacgctctggttatcgtcttggagacggacaggtttatgacgtaatcctgcgcgatggcctgatgtgcgccacccatggttatcatatggggattaccgccgaaaacgtggctaaagagtacggaattacccgtgaaatgcaggatgaactggcgctacattcacagcgtaaagcggcagccgcaattgagtccggtgcttttacagccgaaatcgtcccggtaaatgttgtcactcgaaagaaaaccttcgtcttcagtcaagacgaattcccgaaagcgaattcaacggctgaagcgttaggtgcattgcgcccggccttcgataaagcaggaacagtcaccgctgggaacgcgtctggtattaacgacggtgctgccgctctggtgattatggaagaatctgcggcgctggcagcaggccttacccccctggctcgcattaaaagttatgccagcggtggcgtgccccccgcattgatgggtatggggccagtacctgccacgcaaaaagcgttacaactggcggggctgcaactggcggatattgatctcattgaggctaatgaagcatttgctgcacagttccttgccgttgggaaaaacctgggctttgattctgagaaagtgaatgtcaacggcggggccatcgcgctcgggcatcctatcggtgccagtggtgctcgtattctggtcacactattacatgccatgcaggcacgcgataaaacgctggggctggcaacactgtgcattggcggcggtcagggaattgcgatggtgattgaacggttgaattaatcaataaaaacacccgatagcgaaagttatcgggtgttttcttgaacatcgacggcgaaggtaaccccattaatcaccagtcaaaacttttcaccagcgtcagctcgccagcattacgcatcggtacaataaatgtttcctgtttctcattgaccgatccttcatcggtgatcagcgtcagttgggcggtggttaattccgtttcgctgcgcccaccatagtagttgatatacacctgatagcgcccgtgaattggcgcgggcatggcgaaaatctcgggtccgtaccccgtcgtgacatccatatccagtgcaccactgtttttcagcacggtgttaccgtaccaggcgtgttcgccatcgggcgtaacaacgtgaaggtcgaggtcggtattgtccgtatcccacgagagaaccagccgtaaacgtgcacgaatcgttcctgtacccggcgttgagtaaaactgcattttttgtcggctttgcccatccgggctgatgacctgcacgctgttgctgccttcagtgaaaatataagggcgtgcaaatgaaccatcggattcaattctctgcggcatactggcaccgttgaccaccagccggccctgctgaactttacccgccgcagcataattctttattttgccgcggatctgcgctgagatattttgatcatctgccatgttgacggacgacgccgggtaattgatcgattgtgaaaaactggcatcttcgccctctgccggatgccagcctgagagcggtgcatcaatctcgacttcctgcacaccttcactgtgagcgacaggcgaaagcgccaccagtaacaacggaagaaaaatctttcgcatagcattagtccattaataattgtcgggtcagcgtttcgatatagttctcatcaagcccggtgggataaccatcaaaggccaggtgcagatactcatgggttaaatccagccgatcctgaagcgtaaagaagttacgaataaacagccgtttctgctgccgatcggtataggggaaacctgagactaaacggcaaaccgcaaacacgtctggttcgttgtaccccgtctcagcttgtaatatacgccgccactgcggcatttttttcgccagccaggctttcgctttgggtaataactggcaggttgagcgtggcgctccccagcggctaagactgttgtcgggataagcaaacgcgagtatctgatcgtaacgctctccctgccccgcctgggccgtggcttgccgccaggaaagtgtcccttcggtagcgcgactgccatgataatgaaccggatcgcctgcatagatgagatcctgcgtccaggcggtcatcgttcgcgcccccgtggtcgctggcgaagcagaaacacgctgcgtggcgctgctgtcggggatggtcaggcaatcgccttcccgattggcgttttgctgtaaaaaagtgcgaatcgccacggtcatggctttcgctgcctcagggggcgtacttttcgcctcgcgatccagaactctggcaacgtactcttcacgatcgagatgcgactgcaatttcagtttgcccttttcgctcagtaaggtcgtctcaccgtggctgacaaacgtaatgtggttaccattagtaaacgtcacacgatagcgcccattaagtacgccgggatttactgccgtcgtactcttttccgctgtgattttcttcagcggatagcgggcaaacagctccacctctacacattgcccactggcaacctgcgtcggcactggcaaaacccgattaagcaccgtcgcataacgggttagtaccgttttgctggtgccactgccagtaacccacagcggtgtaccatcggttaaccagccagcaaaaccaccctgacggatttcctgtttatcatcggcaaaccagctccaggttttcacccgtacccgactaccgagcatggatgcgacaccgattttcgcctcgtccagcaccacatccagtaagacttcctgagctttgttttgcgcgggtaacgtcgctaatgaatcaagcagcgatttaaccgttaccgaggtttctggcttcagcgtagtcagagacgctaaccacgcaggtgcctgacgctgttgccagtattgcccccacacatctgcgccaatatgcaaccgctgcggcgcaaaatagagcccacaggaacgtaccagcgcggtatcgcgcgttatgctctccccagcctgacaacaataaacctcttccggggagtttccgcgacactggtagggctgctccggttgatgggtatcctccagccaggcgtaaacatacagtttccacaaactccctaacggcgtggtgagcgagtcaggtaatgctgagactttggtcacgcctgatgacgacagctgatacagttgatcgtgctgcgcaccgcgcagcaccagttgtaacggcgtctcctccgcaagtgttggcagagtaaccaacgccaatagccagacgattctgcgccagttcacttatttcacctgcatcccggtccattcactccctgccgcaacactttgctgcgcaggtgcataggaacgcacataacgagcaggaggcagaacgaattgccctttttgcgagaagcgcagcaaatggcggaaagtgaccgttcccgtcagttctttcaccggcaccatataggccagttcgcccatttcatttcgcgctttttccagcaattgcccctgctgtttcgcggcgttgggtttattgaccgaaatgccccatgttgtgcgctcaacgtcggctcccggtggcagcggtacttccacctgaccgtagcgcagaactgcatcctgctcgctggtaagcgtgatttcatcgagatacagcgcatcgctgtcaatctcattgctggtcaccggttgcagaataaagctcatctcttcttcaccagggataagccgatacaactggcgttcaacggtcaccggaatgttactttgttgagccatttttgccggctcacgtcagcggacctgcacattttgcggcgataattcgtcaccaaaagagagaatgtccggcacgccctgaccaacccaacgccagtcttcgccccctccagttaacttatgtttagcccatgcgcccgcaggcgcaggcaaaacaactggaggcattgtcgccatatatttcgccagccagttcatggccagcgcgcgctcaatagtggattgctcagcggtcaaaccacttaaaatagcggccgtctgggtagcgtcgccaccgctattaagcagcacaaccgtgtgcgccagcggctgattgctgtttgccgctttatcccacgcatattgctgaacctgtggcatcaccgtggacttcaactgcgcttttttcagcaacgtcatggttaagacgtttgccaccgcatctgccagtggagactccggtgtatcgaggatcaggctatcattgatatcgcgggtgtcttcctcagagaaatcttcagttttagttccgcgccgggcgatagcttcatccaaccctttcaacaacgttttgcacggcaaattcatctcctgcgcccatgccagcaccagcgcccgatgcaataacggcatgttatctgcctgctccgcgtagctgtcgagcatatgctgccagtattccggttgttgcgttacgccgatcgcctggctggcctgccagtcggcgtaccatgcccatgccgtaaggaaggcgtcaccattgccatcttcaccccaccaggtaaagcgcgctccgggccccgccagttgcatcagccgcagacggttatcctgaatcatctgacgaatgtcgttagcggcggcactttgatgatcggcaagcgaacgccaggcgagactgagcgggatcagacggctaccggtgttgattacgccaccccacggttcatcgactaacgcatcaagattgttgcggaaaatctcctgcggcgtttcactactttgtagccggatattgctcgcctgctcgggcaacatcagcgcgttatcgccaccaccgagcatgacatttttctgctgttcaacgggccagctgttatccacaaaagacagttttgtgctaatgctgtcctgcacttgcccattttgttgcagttctgcacttaacaagccagattgctgaatattctgcgtcagcgaaatataattcgcccctttgtgcagcgtcagcgtctggcgcatctcagcgcctgcaaatttagtcaccagcgccaccggttcgttatcctgctgactgaagataaacagtcctgccgccggtttgtcgcccacgcgatacaccgttggcatactccacttcatgtagagatttttttccgaacgcagataagcacgcccctgcccgaccagcccgtcgccgttcatcccacgcgcggtgatacgccagcgggttaacgaatcaggcatcaggaacgtgaaatacgctttgccttgtttatcggttgtgagtgacggcatccatgccgcggtatccacctcttcacgccgtggacgttcaagcatttttactcgccgctcgctgcggttagttgcgccaggcgcaaccggctcgctggagagcgcctggtcgtagctgataaacgacagactggagctggtacgcacattgttacgccccagcggatagaaaaatttgccgatattcggcgcgatttctggttgcagcgcgtagatcatttcatcgaccacgcctaccgttagctgcgcagaaacaggtttacctttcagcgacgaggttaattcgacattgaccagttcaccaggctggtaatgggttttgtccgttttcacccggatatccagctggggaacggcaactttgatcccggcgttctgaaaactgtactgaccgttacgggtatacagcaccgaaaaagtgatgttaggcgcaaaggaattgctcactggaacccgggcttcatactgggtatcgtttaaacgttgtagcgttagccagtttgccggatgcgaaagcagcgactgctgttccacgcgatcgcgttccagcgtcaataatgcttcatcaattggctccggaaaggtaatcagcatcttcgcggtttcgcctggctggtacagcgttttatccgccacgatatctaccgtaccagtatgcgccgtgctgcccttaccgctgacggcatgacttaacccagcgagaattaagccgtctttatcgcgtaatgtcagattgtagttgccaggtttagcgaaattgacggtaaaggatttgccgcctgacggtagctctccgctatggctcgtgcggtcttcgagacgcaaccattcatacgtaacaggaacctgttttgaagattccagcgcggcataacggaacacaaccgactcgccgctattactgtattgtgcggcagtacttaatgagtaatgcgccagaccgcgttcaatgaggatctctttggtggtggtgacgcgatacgccgcgccgtcactggcggagacggttaacaaatagcggctcggtttatcggcggcggggagatttaacgccacatgaccgctggcgtcggacaccgtttcgctgccttccagcgacacggggaaacgtccggcataacgcaaatcgttaccgaccattgataattgctgagcgcgcaaacttaactgcacgcgggcattttttaccggctcgccatccgggtagagcagttgcagtttgccgctgaccgcttcgccagttttgaactcttttttggcgagagctaaaccaatctcgaaatgtggcttgatgtagtttgccacgcgaaaactgctgctatagacctgattgcggtaagcaagacgtaactcataacctccggctacggcattttctggcaggcggaaacttccctgcccgccattgcgcgcatccagcgtgacattgacggtttgcaacagactgccgttggcgtccagcaccgaaagcttcgccggggcgctgacgatgggggatgaatgcaacggatcgtggaactcgcggccgatcactttaacatcgacacgatcgcctgcgcgatatagcgggcgatcggtaaaaatatacaagcgggtgttgtagatttcgctttcgtagaagaagttctcggagacaaaaacgccgccttcagcatccttacccagaatgtatgaacgttctggcgatatatgttgtaactgcaaggtaccgctgtcatcggtcacaccgcgggtcatcacgccaagaccgtcagtccacaagatctctgagccgggcttcgcttcaccctgttttttacccgcggtccacaccagaagctctttgcctgacactttgctaagcgccacggtatcggaaacaaacaccaccgtcgtcgcccgatacccaccaaccatcgcctcgacgaggtacagtcccggctcttgttggccgagaggaatataaatgttacccggctgcggcgagatgaaattgctggatgcgccttccagttttaccccttgctgcggctcgaacggtttagcctgccatagtggataacggaactgtttcaccaggggatattttttcagcggggaaaactggttgttctgtacataacgggaaggtttaataatggcattgccgagctgtaattcgggtaacgcctgagtcacattctgccgtgactgagaagagaaagtacgctgcatcacgcggcgagatttgccgtaccagttatcccacagccaggttagcgtattgttcagcccgtcgcccagatattgcggttgcaccacaatgcgatgcaggtttttctgctggcgcaaaaatgccatcgggtcaggaatacgatacaggcgaacgtccacgccgccgtactcttccatctgatagcgccgataatcacgccccggcgcttccagtcgcactttcgcctcttcactgctgctaaaactgctgtcagcaagcaaaaagaatgttcccccggcaggcggcgcatagttgctggaaggaagcgaatcatcagcattagcaagccctgttcccacaagagacagggacaagcacgctgctatcgcgccagaaaatttaaacgataaatgccaatgaaattgggattggaatcgttgggtatccatcgggtgtccttccatgtcataagttgttgcagactgactgcgcgcattccgttgtcagttttcgtggcgcttccggtgtggtagatgacgtaacgccccatccagaccattaagtgctgggcatcgccctgatcgaaaaaaatcatatcgccaggcagcgcctggtttatgtcctggccaataaactggctgttgtactgaatcaaattaatcgcggtcacataggggccggttttcccgttcccctgattccagttttgcgccagttgacgctgttcaggtgttagcgtcatctctggcggcaaatactggctagataaaccgttactttttagccatttactgtcgtgaactttcagcgtctcgttcgccgcaaatcgcaccaggcccgcacaatcctgctgataccagcgtggacttggcccctggcggagctgttcttgtgcaatgcgtacaaaccaggcgcgaaacagcccggattgttcgacattcagcatttcgctatgggcaacaacacaacacagccagcaaatcagcgccagcagcccgtgcctcatagcggctgccaggttatgggtagccactgccaggcggcaccgggttccatctgggccagcttcatgacataacgcggttgttgagataaagcgtccagcttcggcattaataaagtttgtgcggcgttataaaaaaccggttcgagattcttcggcagactggtcaacgtttcgttacgcagcagtttcgctattccttgtggattgatatagagcggaacgatgccatcagtgggtattacatccaccattgccgggcgggttttattcagtgtttgcagcgcgttattaaccagcgtgtcatcgagggagaaaagcagcgttttgttttgcatcgccagcgacacacggaaaaaataatccgacattaattgatcgggttgcgccgcctgcgctttcggatactggccgtatcgggaactcacttcgcgacgccagatttgcgcttcgccctgctgagtctggcttaccggcaaaacaccttctggcgctttgctttcgtgcgcaccaatattttgcgtaaacagtttccctggcaattgcgcctgttcggcagtgccatcaaactgaccgacaaacagcggggtttgcaattttgagtcttcataccagcacagccccgcggcaccgtctaacgccccattcagcttgtcgttttcctggctgatgtgcgaaagcatctcttcggcaataccgtgtgaatacggcaccgccacacagaagctggctccggcaggcatactgttccataccggcgtaaaatcgaaactggcatctacgctggcggattcatcatttaacgccacaaaactgtgccagccgtcgttacccatttcgaagcgtacgccagcaaaagaaggcattaaccgctggtagccaaaccccagccacctggcgctgactacgatgcgctggcgtactggcgttttttcggcagtacgctcttccaggccaaagcttgcttgccagcgttttttgccgctcaacaaatcacctgcgatcgccgtggcttcggtatcctgctgatcatctttaaacaacatatccgtgctggaaaacaccagcatcttgtcctgataagtcgcgaacatcagggcgttattgccgttatagcgcaactgataaacaggaacagtttcactatttatcttgatgctactgatttccgttttgcttaactggctgtcgctggtagcggcaaacaacaatggctccagcagtttgcttaaaccactgcgctggatcagcaccatataatgtgaaagatggccttgtttatcgtgccacagcgctgcctgcgcgggctgatctaagagtgacgaaaagagcttatctttcagcgtgagatcgtgttcatagacaatacgacgaatgctgccttcaatgcccagacgatcggcatgattctgataatagaaaacgaaatcttcgctcagaacatcgtggagaaacggaatggtgaggagatctttgggaagctggctcagagagtcgctgtcgagaaagaggtccggctcattgagatcgatttgcagattgttgtgcaccaccagcggcgacaacgttttttctggcccactgccagcatattgcaacgcccagacgccagcggaaagcagtgctattgcgccaaaacctacaagaccatagaaccgccagcctttcgcctttttttcaccactcattgccacattccttgtgtatagccagccattttttacgggcacagccaaactttaccgtgccctaatacgacaaaagcccagactttgcagcctggacttttcaattcaaacaagggagatagctcccttttggcatgaagaagtaaaattattcttcttctggctcgtcgtcaacgtccacttccggagcgatttcatcgtccccttccgcggcactgccgtcgatggtatccagatcttcctcgtcaaccggttcagcaacacgttgcagacccactacgttttcatcttccgcagtacggatgaggatcacgccctgggtgttacggcccacgatgctgatttccgaaacgcgagtacgtaccagcgtaccggcatcggtgatcatcatgatctggtcgcagtcatctacctgtaccgcgccaacaactaaaccgttacgttcggtaaccttgatggagataacccctttcgtcgcacgcgacttggttgggtattccgccactgcggtacgtttaccgtaaccgttttgcgttgcggtgaggattgcgccatcgccacgaggcacgatcagagagacgactttatcgccttcacctaagcgaataccgcgaacaccggtggtgttgcagcccatcgcacggacagaagactctttaaagcgcaccactttaccttcagcggagaacagcattacttcgtcttcgccgctggtcaggtcaacgccgatcagctcatcgccgtcaaccagtttgatcgccactttaccggcggtacgcagacggttgaactcggtgaggacagttttcttcacggtaccgttagcggtcgccatgaagactttcacgccttcttcaaactcggtcactggcaggatcgcagtgatacgttcgtcctgctccagcggcagcaggttgacgatcggacgaccgcgcgcgccacgagtggcttccggcaactgataaactttcatcgaatagacgcgaccacggctggagaagcacagaatatggtcgtgagtgttcgccaccagcagtcggtcgataaagtcttcttctttaatacgtgcggcagatttacctttcccgccacgacgctgcgcttcgtattcagaaagcggctgatacttaacgtagccctggtgagagagcgtcacgaccacatcttcctgggtgatcagatcttccaggttgatgtctgcgctgttggcggtgatttcagtacgacgtttgtcaccgaactgttcacgaaccagctccagctcttcacggatcacttccatcagacgatcggcgctaccaagaatacgcaacagttccgcgatctgatccagcagctctttgtattcgtcgagcagtttttcgtgctcaagaccggtcagtttctgcaaacgcagatccagaatcgcctgagcttgctgttcggtcaggtagtacagaccatcacgcacgccgaactctggctccagccattccggacgcgcagcatcgtcgccagcacgttcgagcatcgcggcaacgttgcccagctgccacggattagcaaccagcgcagttttcgcttctgcaggcgtcggcgcatgacggatcagttcgatgatcgggtcgatgttcgccagcgccacggctaatgcttcaaggatatgagcacgatcgcgagctttacgcagttcgaaaatagtacgacgggtcaccacttcacggcggtgacgaacaaacgccgcgatgatgtctttcaggttcatgatcttcggctgaccatggtgcaatgccaccatgttgataccgaaagaaacctgcaactgggtctgggagtagaggttgttgagcacaacttcaccgaccgcatcgcgtttcacttcaatcacgatgcgcataccgtctttgtcagactcgtcacgcagcgcgctgatgccttccacgcgtttttcttttaccagttccgcaatcttctcgatcaggcgcgctttgtttacctgatacggaatttcgtggacgataatggtttcacgaccggttttggcgtcaacttccacttctgcgcgagcgcggatatacaccttgccgcgaccggtacggtaagcttcttcaataccgcgacgaccgttaatgattgccgccgtcgggaagtccggccccgggatgtgttccatcagcccttcaatgctgatgtcttcatcatcaatatacgccagacaaccgttgatgacttccgtcaggttgtgcggcgggatgttggttgccatacctacggcgataccggaagaaccgttcaccagcaggttaggaattttggttggcatgacgtccggaattttttccgtgccgtcatagttatcaacgaaatcgaccgtctctttttcgagatcggccatcagttcatgggcaattttcgccagacggatttccgtataacgcattgccgccgcagagtcgccgtcgatagaaccgaagttaccctgaccgtctaccagcatataacgcagcgagaatggctgcgccatgcggacgatcgtgtcatagaccgccgagtcaccatggggatggtatttaccgattacgtcaccaacgacacgggcagattttttataggctttgttccagtcattgcctagtacgttcatggcgtaaagtacgcgacggtgtaccggcttcaggccatctcggacatctggcagcgcacggccaacaatgaccgacatcgcataatccagataggagctcttcagctcttcctcaatgttgaccggtgtaatttctctcgcaaggtcgctcatctaaccgctatccctctactgtatcccggattcaaaggtcgcaaattataacacagccgcgcagtttgaggtaaacctatacgctttattcacatccaatgcctgatatactcgtttgtcttgccaattacggagtagaagtgccaatgaatgccgaaaaatcgccggtaaaccataacgtagaccacgaagagatcgctaaatttgaagccgtcgcctcccgctggtgggatctggaaggtgagttcaaaccgctgcaccgcattaacccgctgcgtctgggctatattgccgagcgtgctggcggtttatttggcaaaaaggtgctcgatgtcggttgtggcggcggcattctggccgagagtatggcgcgcgaaggcgcgacggtgaccggtctggatatgggctttgagccattgcaggtggcaaaactgcacgcactggaaagcggcattcaggtggattacgtgcaggaaaccgtggaagagcacgcggcaaaacatgccgggcagtatgatgtggtgacctgcatggagatgctggagcacgtccccgatccgcagtcagtggtcagagcctgtgcgcaactggtgaaaccaggcggcgatgtctttttctcgacacttaaccgcaacggcaagtcatggctgatggcggtggttggtgcggaatatattttgcgcatggtgcccaaaggcacgcatgatgtgaagaagtttattaaaccggcagaattgctgggctgggtggatcagaccagtttaaaagagcggcatatcactgggctgcattacaacccgatcactaatacttttaaactcggccccggcgtggatgtgaactatatgctgcacacgcagaataagtgaggttgatgtttggccgcgccaatgcctgatgcgacgcttgccgcgtcttatcaggcctacaaatgctccccgtaggccggataaggcgtttacgccgcatccggcaaccgtgccgactagacagtgattaccatttcaccgtcatcgacaaaaaccctgccgtctgggcaaaatcatcactccctttctgccacgccacgctgccgcgcagggacactcgctgactgatattgcccgtgactcccacttttatttcaccccgttgcttcaccgcatcgtcactgatagtgctgccatcctcttcaatttccgtcgaatggggatcgtgataataattcagatctaatgttggtatgacatgaacagcggtacgccattcgctgtgtaaacccagccgcgtctgaatatcatcaccctgcgattgtgacacgcgcgcacggttagcggcggtaaaatcatcctgctgcacgccctgataaatcacctgcgcctgcggttcaatcaccacaccacgccccggtaaccactgataccccgcctccagcgaggcgataatccccgacgagtggtaatgatctgtgccatcttcttgttcggaaacatcattgctaaaccacgcgtattgcagccagctatccagccaggccccttgcttctgattaccgtgctgaaaccagcttgatgtcagcccaacggcataaccgtggttctggttatcggcgcgagttccggtcatattcgagcggctgtcgccctggttatcgctgtagccaccaacaatcccaagcatccactcgccatccgtgccccagcgcccgctaaacagatcgccgctaagttgcaccgtagaagtgtcttcatgttgagccagttgccccgctgctgtgtaatgataatctccgccgataacacgtaaattcagcgtctgaccatcgccacctgcgtgatcgcgtcgctccatcataaacgcctgatttgccgcccgcaggttattaagataaccgccaactttggcattcaacaccggctggtaagcaggcgtaggttccgggtcgggtgttggatcaggatccggcgtgggatcaggatcgggagtcgggtctggatcaggtggcgatggcggcgttacttcttgcgatcgcagataccagtcgttgttatcttccaccagcgtgtagtcatacgctcccatattgacgtagccgctgcctgccagactgaactgcgcattgttttgaaactgcgtgggatcagctgcgaaatcaaccactttaatgcctgtcgatgtcggctcaccaatccctgtaatggagttaaccaccacagttgtgttgccagcagtattaccgttcatcaccaattgatcgcttaccgagtcatcgccgtttaattcgctatcgagcagtagcgtaccgccgccggtataatcaccgtttaccgtcagcgtatcgccagcgacgccattttgcaggctaaccgcaccggacgtattggtcagattgccattaaccgtcacgttggaaagataagtcaggctgtcagtttcaaggttggtattaagctcacctgtcaacgtcacaccatcggtggcattcaccagcgtcccatcgccgttaaatagtgaggcattaagggcgacggaagtatcctgcccggtcaggcgcaaaaccgtaccatcgctgatgtcgatagtgccgctggaaatagcatcaattgactgaatatcctgatccgcgccagtaacgaacgttgccccatcaccaacccacagtgacgaagcataaggaaggatatcagcaacatcacctttcagggtgccttcttcgacacgtaccgccgactgcgttgtaccgctggcggtcagctccagtgtaccagcccccgttttagtcaatgtgctaccctcatcctgatgctgcccgctgctgtcagccatcagtgcgccccactgcgtgtctacccccgcatcaactgccacttcaccgtcggcgcgcatttcaatatcacgtccgtggcctgccgcatctgaacgcgtgtcaacgtcggaggtaatctccatcacgctttcttgttgcttatcggtaaagataacctggcggttatagtgggtatctccaagctgcgagttgtcgctcaccatcagcgtaccggaggcgatttgtgttgtgcccaaataactattattgtttgccagacttacctgcccgtcgctcgcatcgaccaccacgtagacgccatctttcccgtcgccgccgatatgcaaattgtcgccacctgcaagatctaccacatcctgactgccgataaccgttccgctgctgccactgacttcaaggccatcgttgtatgatgtgccgctctgccaggtggagaaatcagagagatcgagcacaccgccgtttaacacgatcgactgcggatcgtcctggagagcggtaagatctgccgcgtcgccttccagcgaaagcaccgcaccatcatcaacgactatatcgccggttagcgccatcgactgcgcccctgccagcacgtagctgccgttttgcgcaatggtgagctgaccagcaccttcgatgatgccagcaaaactgccctgattaacagtaacgttgccaccagcatcgatatttaaagtgccattctgaaagcccgtcaatgcgtgcacaaaagtttgttgggtcgagccaacgtttagctcagcctgattctgatactgatcaatactccctatcgtcagaccgtagcagtcttgcggatcgtcctggcaatgcgtatcgccgacattcatcagggagttgctgcggcccagggtaacttcaccgttttcaatctgcatctcaccagtaaagtcattgttatctgcattaagtaccagatcgccggaacctgttttggtgattaacccggtaccagcaatagagtcaacagctccgtcattctctgtattgccaataaccagcgtttttccgtcggcaatatcaaaggtaacttcacttaagccgagatacataaagccacccgccgcagaggaaggaccatctccatagcctgctgcgctattgttctcatcgactaacacgcctccgttctggctgtagctgtcatcaacagaaatatcaataagatagggagccgtcacgctattggtatatatcgccccgccataaccttcggcagtgttatttgtaaaggcagtgttatttactatcgtataacctgaaggatgcttgctgtcgctattattatcggtaacatcgattgccccgccatcgccatcactgtaacttgttgatgtatatgcctggttgttatcaaaaataacatcacttaaataaacgtcattattaatggtataaattgcgccacctttgccatcattagcgatgttattgcgaaacatggcgttagtgacacgtaaatcgacggcaccagtatcgttagtaccagaagaatagattgcgccaccatagccgcctgcgacgttaccggaaaaaataacatcagtaagattcagcgttgagttttctttagcaaatatggccccgccgttattatattctcctgtaacggtgttattggcaaacagagtcattccagtttcattttctggtaatagtgaaaattccgctccttgttgcaaaaatacggccccaccgctggcgttattggtcatatccgaaaaaaccagccattgcccatcagcgatactccagtcctgcgtaatgcctgaaaggctttgcctgctggcctgacaactcgctttgacatcatatccctggcatgaatcagtgaccgccgcgacaccgttagcagagaaaagagatgcaatcattgacgggagtaaagataaatactccttgcgtagaaagataatccgcatattaatctaaccatcattttctataagacggcgtatttaatcgcattatacgatatggaatatctttcttttgtaaattgttcaacccggtgcaatggctattttgttattatttgatgaataatatcagtgcgtcataattcaagttaataaccttcagggatatcagttatatttaaactaaattaaagtcatgaataattttcttataatataaggtaaattaacaaaatggcttagcatttaacaataaccgaatagaaaacaaccatttcgccatcaacaatctcttacattcgcttatatattgaccacaactgatacatcagattatgtgatgactcgtgcttagatcaatttttgcaatcattagcaaaaagattaataagccatctatatcaatttatctaacctattatgccgttcaagaaatcgccgaacagttatttttaacaaatttttctcttcccattgactttcccggacaccttgtctgacctaaggtgcgcgaaagccactttttccttcctgagttatccacaaagttatgcacttgcaagagggtcattttcacactatcttgcagtgaatcccaaacataccccctatatatagtgttctaagcagcttcccgtactacaggtagtctgcatgaaactattgcggaaagaattccaaaaacaggtacgacatacatgaatcagaatctgctggtgacaaagcgcgacggtagcacagagcgcatcaatctcgacaaaatccatcgcgttctggattgggcggcagaaggactgcataacgtttcgatttcccaggtcgagctgcgctcccacattcagttttatgacggtatcaagacctctgacatccacgaaaccattatcaaggctgccgcagacctgatctcccgtgatgcgccggattatcagtatctcgccgcgcgcctggcgatcttccacctgcgtaaaaaagcctacggccagtttgagccgcctgcgctgtacgaccacgtggtgaaaatggtcgagatgggcaaatacgataatcatctgctggaagactacacggaagaagagttcaagcagatggacacctttatcgatcacgaccgtgatatgaccttctcttatgctgccgttaagcagctggaaggcaaatatctggtacagaaccgcgtgaccggcgaaatctatgagagcgcccagttcctttatattctagttgccgcgtgcttgttctcgaactacccgcgtgaaacgcgcctgcaatatgtgaagcgtttttacgacgcggtttccacatttaaaatttcgctgccgacgccaatcatgtccggcgtgcgtaccccgactcgtcagttcagctcctgcgtactgatcgagtgcggtgacagcctggattccatcaacgccacctccagcgcgattgttaaatacgtttcccagcgtgccgggatcggcatcaacgccgggcgtattcgtgcgctgggtagcccgattcgcggtggtgaagcgttccataccggctgcattccgttctacaaacatttccagacagcggtgaaatcctgctctcagggcggtgtgcgcggcggtgcggcaacgctgttctacccgatgtggcatctggaagtggaaagcctgctggtgttgaaaaacaaccgtggtgtggaaggcaaccgcgtgcgtcatatggactacggggtacaaatcaacaaactgatgtatacccgtctgctgaaaggtgaagatatcaccctgttcagcccgtccgacgtaccggggctgtacgacgcgttcttcgccgatcaggaagagtttgaacgtctgtataccaaatatgagaaagacgacagcatccgcaagcagcgtgtgaaagccgttgagctgttctcgctgatgatgcaggaacgtgcgtctaccggtcgtatctatattcagaacgttgaccactgcaatacccatagcccgtttgatccggccatcgcgccagtgcgtcagtctaacctgtgcctggagatagccctgccgaccaaaccgctgaacgacgtcaacgacgagaacggtgaaatcgcgctgtgtacgctgtctgctttcaacctgggcgcaattaataacctggatgaactggaagagctggcaattctggcggttcgtgcacttgacgcgctgctggattatcaggattacccgatcccggccgccaaacgtggagcgatgggtcgtcgtacgctgggtattggtgtgatcaacttcgcttactacctggcgaagcacggtaaacgctactccgacggcagcgccaacaacctgacgcataaaaccttcgaagccattcagtattacctgctgaaagcctctaatgagctggcgaaagagcaaggcgcgtgcccgtggtttaacgaaaccacttacgcgaaagggatcctgccgatcgatacctataagaaagatctggataccatcgctaatgagccgctgcattacgactgggaagctctgcgtgagtcaatcaaaacgcacggtctgcgtaactccacgctttctgctctgatgccgtccgagacttcttcgcagatctctaacgccactaacggtattgaaccgccgcgcggttacgtcagcatcaaagcgtcgaaagacggtattttgcgccaggtggtgccggactacgagcacctgcacgacgcctatgagctgctgtgggaaatgccgggtaacgatggttatctgcaactggtgggtatcatgcagaaatttatcgatcagtcgatctctgccaacaccaactacgatccgtcacgcttcccgtcaggaaaagtgccgatgcagcagttgctgaaagacctgctcaccgcctacaaattcggggtcaaaacactgtattatcagaacacccgtgacggcgctgaagacgcacaagacgatctggtgccgtcaatccaggacgatggctgcgaaagcggcgcatgtaagatctgatattgagatgccggatgcggcgtaaacgccttatccggcctacggctcggtttgtaggcctgataagacgcgccagcgtcgcatcaggctccgggtgccggatgcagcgtgaacgccttatccggcctacggctcggatttgtaggcctgataagacgcgccagcgtcgcatcaggcacaggatgcggcgtaaaatgccttatccggcattaaactcccaacaggacacactcatggcatataccaccttttcacagacgaaaaatgatcagctcaaagaaccgatgttctttggtcagccggtcaacgtggctcgctacgatcagcaaaaatatgacatcttcgaaaagctgatcgaaaagcagctctctttcttctggcgtccggaagaagttgacgtctcccgcgaccgtatagattaccaggcgctgccggagcacgaaaaacacatctttatcagcaacctgaaatatcagacgctgctggattccattcagggtcgtagcccgaacgtggcgctattgccgcttatttctattccggaactggaaacctgggtcgaaacctgggcgttctcagaaacgattcattcccgttcctatactcatatcattcgtaatatcgttaacgatccgtctgttgtgtttgacgatatcgtcaccaacgagcagatccagaaacgtgcggaagggatctccagctattacgatgagctgatcgaaatgaccagctactggcatctgctgggcgaaggtacccacaccgttaacggtaaaactgtgaccgttagcctgcgcgagctgaagaaaaaactgtatctctgcctgatgagcgttaacgcgctggaagcgattcgtttctacgtcagctttgcttgttccttcgcatttgcagaacgcgaattgatggaaggcaacgccaaaattattcgcctgattgcccgcgacgaagccctgcacctgaccggcacccagcatatgctgaatctgctgcgcagcggcgcggacgatcctgagatggcggaaattgccgaagagtgtaagcaggagtgctatgacctgtttgttcaggcagctcaacaggagaaagactgggcggattatctgttccgcgacggttcgatgattggtctgaataaagacattctctgccagtacgttgaatacatcaccaatatccgtatgcaggcagtcggtttggatctgccgttccagacgcgctccaacccgatcccgtggatcaacacttggctggtgtctgataacgtgcaggttgctccgcaggaagtggaagtcagttcttatctggtcgggcagattgactcggaagtggacaccgacgatttgagtaacttccagctctgatggcccgcgttaccctgcgcatcactggcacacaactgctgtgccaggatgaacacccttcccttctggcggcgctggaatcccacaatgtggcggttgagtaccagtgtcgcgaaggttactgcggctcctgtcgcacacgcctggttgcaggtcaagttgactggattgccgaaccgttagcctttattcagccgggggaaattttgccctgttgttgccgggcaaaaggcgatattgaaatcgagatgtgaattggttgtagtgccagatacaacgcttatgcgtcttatctggcctacaacgattacatggcgtagtaatacgctttcacctgctcccagtccgctttggggattggctccagatatttttccagctggcggaagtcatgattaatcgctttatcgcgacgcaagcggcgacgacttttctccaggtcaagaaaaccagcttctgcattaccttctgttttcacatagatatggcgaacataacaacagccatgctgacgattaatgctatgcattttcttaaacgccagcgccactgctttcaacatggcttgccgtacttcgtcagaataaggcgatactgcatgctgggcataccagtcagcaatgctgatgaaccccgccatatcttcagtcaccagcaacgctcgccattcaccctcaattttcaccgcttcaccaaaaacgatcttcggcacgatgacaccggcccgttccagttctttaattaccgcaacctcacggacaatcgttggtcggccgaacggataacgtacggaatgaaacagatgatgcgtcatgcgctttacatacagctttttgccgttgcgctcgacgcattgcaccccgctcataccattacggcgatagttaggctcttcaacccagtcgccctctgttgcccaccagtgattaaattcgtcgtactttgctgaaactgccataccctatcgcctgtcatttttattaacgacaatgactataggtggttacctgaggaaaatcttaatgaaacgtgtcgtattaatgaatttcttttgccactactagcttgacaccgcttttacccttcatttgcagcgcatagattccaccagccactaccactaatagtgcgcccagcagataaaatgtgaatttaatcaggcggatacagcgatgaattttattcgacagggattaggcatcgccttacaaccagagttaacgctgaaaagcattgcaggtgaattgtgttccgttcctctcgaaccaactttctatcgacagatttcgttgctggctaaagaaaagccggtagaaggcagtccactgtttttactacaaatgtgcatggaacaattagtggcgattggaaaaatttgatatgagacaggatggcgcatgaacgccatcctgcagtaacattactctttattaagaaattttactgccttatcagggaaatcagtaaacagcccatttacacccgctttgttatacagagcatcatataactgattcacatcaggagtgtattcaggcagtttatctgaccgcacggtataaggatgcactaccagtttattctgctgagcatcttgcaccatgccagtgagtttgatattacccggctgcgatgtctcctcaatcaacatatggtaatccggaccaataccatctgcatattccgccacctgtttcatggcacccggcttaaacatccagtcgtagttgtaattaacccagcttccatccggctgtttctgctgcgtttcattccagtcggtataggcaatcagctgtaccagattgagctccatgcccattttgggttccagctcattcttaatacgcttcagctcatcagcatcaaaacattgcaaataaactttatcgtctttaccggtgtaaccatatttcttcagcacttccagcgtttttgccgcaatatccttcccttcctgatgatggaaccacggcgctttgatttctggataaataccgatatttttcccggtagagtgatttaacccctgaacaaattcaatctcttcttcaaaggtgtgcacccggaagtcggacttacccattgggaaacgccccggataagtctgcacttttttaccgttttcaatatcgaaaccttcggtaaatttcaacgacttaatttcatccagcgtgaaatctatcgcgtagtaacgaccgtctttgcgcgcccgatccgggaaacgatcggcaacatcagtaacacgatcgaggtaatggtcatgcagaacaaccagattgtcgtctttggtcatcaccaaatcctgttccagataatccgctccctgcgcatacgccatcgcttttgctggcagcgtatgctccggcaaatatccactggcaccgcgatgggcgatgactattttttcgttgctgtccgccgccattgcactgcttcccatgactatagtgctcatcatgatcgccatgctaaggtttttcagcgtcaatttcatgccattagcctccgttgcgttcttgcagtaattgttcatggcgacgtttttcgccaatcatcacaacaatcaacaagataaccgccagaatgctgccgccaatcattaccataaagccgccatcccagccgaagaagtccacggtgtagccaacaatcgcgctcgccgccaccgaaccgcccaggtaaccaaacagcccggtaaagcccgctgccgtacctgccgcttttttcggtgccagttccagcgcatgcagaccgatcagcatcacaggaccgtagatcaggaagccgataacaatcatacaaatcatatcgacggttgggttacctgccgggttcatccagtaaacgatagtcgcgatggtcaccagtgtcataaagaaaacgccggttgccccacggttgccacggaagactttatccgacatccagccgcacagcagagtgcccggaatacctgcatattcataaaggaagtaggcccaggaggatttatctagcgcgaaatgcttaacctctttcagataagtcggtgaccagtcgaggatgccgtaacgcagcagataaacgaacacgttggcgatggcgatataccacagcagtttgttcggcagtacgtactgcatgaagatttgcttcgccgtcagctcctgttccgctttttcgttatagtcgtccggataatcatttttgtactcttcgatcggcggcaagccacaggattgcggggtatcgcgcatcatcgcaaaggcgaataatgccaccagaatggcgcagaaagcaggcatatagagcgccgcatgccagtcattgaaccaggccatccccagcaggaacagcagcggcggaataccaccaccgacgttgtgcgcacagttccacactgacacaatgccgccacgttctttctgcgaccaccagtgcaccatagtacgaccacacggcggccaccccatcccctggaaccaaccgcagaggaacaacagtacaaacatcaccgcaatgctcgacgtcgcccatggcacaaagcccataaacaacatcactgccgccgccagaatcaaacctgcgggcaggaaaacgcgcggattcgagcgatccgataccgaacccatgatgaatttcgaaaatccataagcaatcgagatccccgaaagggcaaaacctaaatcaccgcgtgagaatccctgctcaaccagataaggcatagcaagcgcaaagttcttacgaaccaaatagtaagccgcatagccaaagaatatccccaggaaaatttgccagcgcaatcgacgataagtcggatcgatctccgcggcaggtaagcgcgctttgtgtggcgctggtttaaaaatactcaacattgatagcctccgtggcccgtggtcttatttatgattaacagcctgattcagtgagagaacctgccgtttcttgagttgccgcgatgttaagaaaacattcataaattaaatgtgaattgccgcacacattattaaataagatttacaaaatgttcaaaatgacgcatgaaatcacgtttcactttcgaattatgagcgaatatgcgcgaaatcaaacaattcatgtttttactatggctaaatggtaaaaaacgaacttcagagggataacaatgaaaactcgcgactcgcaatcaagtgacgtgattatcattggcggcggcgcaacgggagccgggattgcccgcgactgtgccctgcgcgggctgcgcgtgattttggttgagcgccacgacatcgcaaccggtgccaccgggcgtaaccacggcctgctgcacagcggtgcgcgctatgcggtaaccgatgcggaatcggcccgcgaatgcattagtgaaaaccagatcctgaaacgcattgcacgtcactgcgttgaaccaaccaacggcctgtttatcaccctgccggaagatgacctctccttccaggccacttttattcgcgcctgcgaagaagcagggatcagcgcagaagctatagacccgcagcaagcgcgcattatcgaacctgccgttaacccggcactgattggcgcggtgaaagttccggatggcaccgttgatccatttcgtctgaccgcagcaaacatgctggatgccaaagaacacggtgccgttatccttaccgctcatgaagtcacggggctgattcgtgaaggcgcgacggtgtgcggtgttcgtgtacgtaaccatctcaccggcgaaactcaggcccttcatgcacctgtcgtggttaatgccgctgggatctgggggcaacacattgccgaatatgccgatctgcgcattcgcatgttcccggcgaaaggatcgctgctgatcatggatcaccgcattaaccagcatgtgatcaaccgctgccgtaaaccttccgacgccgatattctggtgcctggcgataccatttcgctgattggtaccacctctttacgtattgattacaacgagattgacgataatcgagtgacggcagaagaggttgatattctgctgcgtgaaggggaaaaactggcccccgtgatggcgaaaacgcgcattttgcgggcctattctggcgtgcgcccgctggttgccagcgatgacgacccgagcggacgtaacgtcagccgtggcatcgtgctgctcgaccatgctgaacgcgatggtctggacggatttatcaccatcaccggtggcaaactgatgacctatcggctgatggctgaatgggctaccgacgcggtatgccgcaaactgggcaacacgcgcccctgtacgactgccgatctggcactgcctggttcacaagaacccgctgaagttaccttgcgtaaagtcatctccctgcctgccccgctgcgcggttctgcggtttatcgtcatggcgatcgcacgcctgcctggctgagcgaaggccgtctgcaccgtagcctggtatgtgagtgcgaagcggtaactgcgggtgaagtgcagtacgcggtagaaaatttaaacgttaatagcctgctggatttacgccgtcgtacccgtgtggggatgggcacctgccagggcgaactctgcgcctgccgcgctgccggactgctgcaacgttttaacgtcacgacgtccgcgcaatctatcgagcaactttccaccttccttaacgaacgctggaaaggcgtgcaacccatcgcctggggagatgcactgcgcgaaagcgaatttacccgctgggtttatcagggattgtgtggtctggagaaggagcagaaagatgcgctttgatactgtcattatgggcggcggcctcgccggattactctgtggcctgcaactgcaaaaacacggcctgcgctgtgccattgtcactcgtggtcaaagcgcactgcatttctcatccggatcgctggatttgctgagccatctgccagatggtcaaccggtgacagacattcacagtggactggaatctttgcgtcagcaggcaccagcccatccttactcccttctcgagccacaacgcgtgctcgatctcgcttgccaggcgcaggcattaatcgctgaaagcggtgcgcaattgcagggcagcgtagaacttgctcaccagcgggttacgccgctcggcactctgcgctctacctggctaagttcgccagaagtccccgtctggccgctgcccgcgaagaaaatatgtgtagtgggaattagcggcctgatggattttcaggcgcaccttgcggcagcttcgttgcgtgaactcggccttgccgttgaaaccgcagaaatagagctgccggaactggatgtgctgcgcaataacgccaccgaatttcgcgcggtgaatatcgcccgtttccttgataatgaagaaaactggccgctgttacttgatgcgcttattcctgtcgccaatacctgcgaaatgatcctgatgcccgcctgcttcggtctggccgatgacaaactgtggcgttggttgaatgaaaaactaccttgttcactgatgcttttgccaacgctgccgccttccgtgctgggcattcgtctgcaaaaccagttacagcgccagtttgtgcgccagggtggcgtgtggatgccgggcgatgaagtgaaaaaagtgacctgtaaaaatggcgtagtgaacgaaatctggacccgcaatcacgccgatattccgctacgtccacgtttcgcggttctcgccagcggcagtttctttagtggcggactggtagcggaacgtaacggcattcgagagccgattctcggccttgatgtgctacaaaccgccacgcggggtgaatggtataagggagatttttttgcgccgcaaccgtggcagcagttcggtgtaaccactgatgagacgctacgcccgtcacaggcagggcaaaccattgaaaacctgtttgccatcggttcggtgctgggcggatttgatcccatcgcccagggatgcggcggcggtgtttgtgccgtcagtgctttacatgccgctcaacagattgcccaacgcgcaggaggccaacaatgaatgacaccagcttcgaaaactgcattaagtgcaccgtctgcaccaccgcctgcccggtgagccgggtgaatcccggttatccagggccaaaacaagccgggccggatggcgagcgtctgcgtttgaaagatggcgcactgtatgacgaggcgctgaaatattgcatcaactgcaaacgttgtgaagtcgcctgcccgtccgatgtgaagattggcgatattatccagcgcgcgcgggcgaaatatgacaccacgcgcccgtcgctgcgtaattttgtgttgagtcataccgacctgatgggtagcgtttccacgccgttcgcaccaatcgtcaacaccgctacctcgctgaaaccggtgcggcagctgcttgatgcggcgttaaaaatcgatcatcgccgcacgctaccgaaatactccttcggcacgttccgtcgctggtatcgcagcgtggcggctcagcaagcacaatataaagaccaggtcgctttctttcacggctgcttcgttaactacaaccatccgcagttaggtaaagatttaattaaagtgctcaacgcaatgggtaccggtgtacaactgctcagcaaagaaaaatgctgcggcgtaccgctaatcgccaacggctttaccgataaagcacgcaaacaggcaattacgaatgtagagtcgatccgcgaagctgtgggagtaaaaggcattccggtgattgccacctcctcaacctgtacatttgccctgcgcgacgaatacccggaagtgctgaatgtcgacaacaaaggcttgcgcgatcatatcgaactggcaacccgctggctgtggcgcaagctggacgaaggcaaaacgttaccgctgaaaccgctgccgctgaaagtggtttatcacactccgtgccatatggaaaaaatgggctggacgctctacaccctggagctgttgcgtaacatcccggggcttgagttaacggtgctggattcccagtgctgcggtattgcgggtacttacggtttcaaaaaagagaactaccccacctcacaagccatcggcgcaccactgttccgccagatagaagaaagcggcgcagatctggtggtcaccgactgcgaaacctgtaaatggcagattgagatgtccacaagtcttcgctgcgaacatccgattacgctactggcccaggcgctggcttaaactcctttctgatgcccggtaagcatgtggttaccgggcatttttgcgtacacgattccgtgcccaatgtatgcgttgcaacgcagtgaaaattcctctgaaaacgtctcgcaaaggctgaaactggcagatgtcaaaggcctgggataaccgtaatgtcgcgtcatcataaatatcaggtgacggacaaccatgaccgaatcaacaacctcctccccgcatgatgcggtatttaaaacctttatgttcacacccgaaaccgcacgggattttctcgaaatacatttaccagaaccactgcgcaagctttgcaacctgcaaaccttacgcctggaacccactagttttattgaaaaaagtttacgcgcttactactcggatgttttgtggtccgtggaaaccagcgacggtgacggctatatctactgcgtgattgaacatcaaagctctgcagaaaagaatatggcttttcggctaatgcgctatgccactgccgccatgcagcgtcaccaggacaaaggctatgacagagtcccgctggtggtgccgttgctgttttatcatggcgaaacctcgccttacccgtactcactcaactggctggatgagtttgacgatccgcaacttgcccggcagttgtacaccgaagcttttctgttggtggatatcaccatcgtacctgacgatgagatcatgcaacatcggcgtatagctctgctggaactgattcaaaagcatattcgcgaccgcgatttaatcggcatggtcgacaggatcaccacgcttttggttagaggcttcactaatgacagccagctacaaacactgtttaattatctgctgcaatgcggcgatacctcccgtttcacccgttttattgaggagattgccgaacgttcaccactacaaaaggagagattaatgactattgctgaacggctacggcaggaagggcatcaaattggctggcaggaaggtatgcatgaacaagccattaaaattgctttgcgcatgctggagcagggctttgaacgtgagattgtgctggcgacaacccaactcactgatgctgatattccgaactgtcattaaaaggagagattaatgactattgctgaacggctgcggcaggaaggacatcaaattggctggcaggaaggtaaattagaaggtttgcatgaacaagccattaaaattgctttgcgcatgctggaacagggctttgatcgtgaccaggtgctcgcggccacccagctaagcgaagccgatctggcagcgaataaccactaattaacacaggcccacagccgatccccatgggcctttgatatcaataactaccttttatgcgtggcccatttttgcctgatttaaacatcgccagtcgttgatccagggcatcgctgtagagcatcgtgtcaacgccaacagcgacaaagttcgctccccacgccaggcattgctgcgccatatcaggagccacagccagaaaaccagccgctttacccgcagcacggatccgccgaatactggtttcaataattcgctgcacttccgggtgcccggcgttatccgggtagcccaacgacgcagaaagatccgcaggtccaataaacacgccatcaatcccttcgacgtcgaggatttcgtccaggttatccagtgccgttttactttccacctgcaccaacagacaaagcgaatcgttaacttgcgccatgtaattctcaatgcgtccccagcgcgcagcccgtgccacactggccccgacaccacgctcaccgtagggaggatagcgcgtggcagacaccacctgacgtgcctgttcggcagtatcgaccatcgggatcagtagagtttgcgcgccaatatccaggacttgtttaatcagcggtttactgccttccaccggacggatcacgggttggctggcatagggcgctaccgcctgtagctgatgataaagatcctgaatggtgtttggcgcgtgctccccgtcaatcagcaaccagtcataaccagaagtggcggcaatttctgccatataggcagtcgttgagcttaaccacagaccaatttgcacttcgcccttgcgtaaacgttctttaaagggattgcttaataatgcgttcatcgtgttccttaacctatttaatgatgtgccacgtcggtctgcgcaacagtgcgatttacacgcagagtgaaaataatcagcgaaccgatgaccgccaccgctgccagcgtcagtaatcccgccgcatcgctggcaaataacgtttctgctttcacgcgcaggatcggggcaataaacccgcccactgcaccaaacaggtttacaaaaccaattcccgcagccagcgccgtaccggaaagcagttgtgtcggcatcgtccagaacactggctgcacggcaataaacccgatagctgcaacacacagcgctacgatcgccattactggagaaagcagcccggacagaccaataccaatgcccgccgccagtaatgtcagcgctgcgacattacgccgttcgccggttttatcggaatagcgcggaataagccaggtcccaaacaaggccgcaacccacggaatggcggtgaccaccgacgctgtaaagcccacttttgttcccagcaatgccgcaacctgggtcggcaggaagaaaattaatccgtaaaccgccacctgaatggtcaggtagataatcgctagttgccagactcggccattacgcagcgcatcgctcagccgagaagtcactttctgttgttcttcacttgccagttgattgataagcaacgttttttcttgtttactcagaaaacgtgcctgctccggtgtgtcatcaagccaaaagaatgtgaataccccagcaccgactgccaacaatccttcaatcacaaacatccagaaccagccgggatgccccataaatccatgcatctccaacagcgcgccggaaagcggtgatcccagtgttaacgccagcggtgcgcccatatagaacagccccataatgctggcgcgattacgctgcggaaaccattgcgaggtgagataaatcataccagggaaaaatccggcctccgcagcacgaagcagagtgcgaactatcagaaatttcgcttcagtatcggcccatgccatggctgccgaaagaaatccccacagcagtgttgtcgtaccaatccaggttctggcccccagtttgcgcatcaaaagattcgccggaacacccagaaacgcatataccacaaagaaaatgcctgctcccagcgcataagcttcattactcaacccggtatcaatctggtaggtctgtttggcaaaaccgatattcgaacggtcgagaaacgccagcacatacagcgccaacataaacggaattaaacgcacacggtttttcttcaccacggcgtcaagcaaagcggtgctcataaaaagctccttagaatatgtgggcgttaccgttgtcacagcaacgcccggagtgattagtggctgtaggggcgtttcaaattgcagtcacgattgagttcgacgccaaaaccgggtttatcaagcactgatttatgaatacgaccattcaccggaaccggctcattgagcagaatcgggtcaaactgcggacgcatcgttgaacaatccgggctggtcatcaggaattcgctgaatggcgtattggtgaaggtgatcaccgcatggtgagagtaaacagacgaaccgtgcggcaccaccagttgccccctggatttggcgattgcggcaatttccaccagcgtggttaaaccaccgcaccagccaacatccggctgcataatgtcgataccggtttctgaaagcgtacgaaaagattgcagtgtgccgtggtgctcaccgctggtgaccatcattccgactggcgcgttgcgtttcagttcgcgataactttcatactgctgtggcggcaggcactcttcgatccatttcaggttatagggcgcgcaagcgtgggccagtttggtcgcatagttcacgtcctgactcatccagcagtcgagcattaaccagaaatcctcaccgcatttttcacgcatatccgcgaccatagcggcatctttgcggatccccgcatcgccatcatgtggcccccagtgcgtcggcattttgccaccgataaagcccatctcttttgccagatccggacgcgcacctgtggcgtagaactgaatctcatcacgaacagcgccgcctaaaagtttataaaccggaagcccgaccactttgccgaacagatcccacagagccagatcgacacaagaaatcgtattcatcaccaggccaccagagccggagtaatacagggtggcactgagcatttgatcgtggatcagtttgatatcactgacacatttaccctcaatgaaacggttaagatgtttttcgacaataaaacagcccatttcaccggctgtcgaaacggcgaatccggtctggccgttttctgcttcgacttcaacaaccaacgtgccaagaacgttaatgccaaatgactggcgtgactgctcgtaatcgcggtatttactcatcggggtggcaatatgatcgtctatccagtgattcgccccctggtcgtgataatcaccgccgccagcgcctttttctgctgtcgcaccgccagtaaaccaggcgcgaacctgtttaatttttggtagggtcatgatgttctccattgttatgaggcttgtaagtcaaagggacttttccatcccaacagacgtgaaatatccctggcgcaggcaatggccttgcccgccagataatcacggtattcttcattgatttgtaagcgggtaccgaccaccgagatcgcagcggtaagctcgttattggcgttaaacaccggcgcagcgacacaacggacatcggcgtaatcttcgccgttgtcatagctccagccctgacggcgaatacgcgccagttcttcgtgaagttgctgtggatgagtaatcgttgtgggtgtcgcctgctcccagaccagcccttcgataatactttgctgtaccgctgcaggttgccaggcaagcaggcatttacctattccggagcgataaagcgaaaggctttttccttcatgggaacgcacgctgatagtggctgatgactccactttcaaaatgtaataagcgctgccgttatcaataatccccaggtgacataacagcccggtggtatccatcagttgcgtcaaacgcggtcgagccagttcccggagatccatcttgcttaacgcatgaccggaaagctccaccagcctggtccacaaacaaaaattttcctggtgatcaaggctaagaaaacgctgacgcctgagttcattaagcagcaaataggccgtgcttttagggattcccaatgtgtcaatgatcgtcgcagcactacaggggccaatgcgggcaatcaaattgagaatatcaatagcccgtgtcagggcgggaactttgcttgattccaacatactggactccagtcttagatactggaatcagtctcgttgctcagggggagtaaaattgtgaagcgcatcaaatcccgctcctcgtccagcagactggagaaattacgcacaaatttgtgaatcagcgcacggattttttcttattgagtacaacaggttggacaaattttgccggagggggaatgtgccggtgcagtaaaccggcacagagtggcggaatcagacagataaggtcatggactcaacaacctcaatccagccatgctcactggcgatatcctggccgtttaaccaacggcgcagcatattcagtgccatcattgcgcacacttcctgacggatagccaggctgtagcgcgtagtgctgaaacgcacacgcagagcgaaagtgccgtctggcgtggctagcgcaaagttgagatgctcgttctcgaaacccgaaacagccagtgccagcccggcaaaatggttggcccgccgttctgtaatccagtgcgcagtttgcgccagggtttcctcctgtgaaggaaccacttcacacgccagcaatggagcacctgcgcgagaaagttgcaaagccaataaaccaccggtgaattgctcgctcaacgtcaggctgaactggcggttttgcaattcgcgactgatctgcgcgggcagtccttcagtgccttcgaaaatcacgctctgtccggcaacacgtttaacatccagccacagtttttccatcgcctgttgctcgcttgccggtccggtgagtttcagttcgatgataggcattgaggagcgatagcccattgttacgcccggcggcagttgtagagtgtccaggctttgtgccagatcgctttccgaacgaccaaaagtagtcaaacgcagacaaaccggcggctgcggtaaagaaaaacgctcgcgcaggcgcggcaggatttcgtgctcgaccatcaccttaaattctgacggtacgccgggagtaaagaacatcaggcaacgattaagctgcacggcaaaaccacaggcggtgcctaccgggttattgataaattcagcactggcaggcagctccgcttgtttacggttgctcggtgccattactcgtccacgttcgtggaaatagcgttccatctctttgagccaggcttcatgcagcaccaggccttcaccttttgctgtcgcagcggcgagtgcgcttaaatcatcgctggtcggtcccagcccgccgttaacgatcagcacatcggcgtgctgactacgttcgcgaagaatggtgactaagtcatcaaggttatcccccaccgtattgcggcgagataatggcaacccctgatgaaagaaaaaatcggccagccaggcagcgttagtgtcaacgatttgcccgtgtaacacttcatccccggtggataacatttccacttttaacatggttatctcctgcttttgttatcgaatcactataacgcaaagggagataaggcgtagtaagaaactgaatggcgcgacagaatgccgcgccggaagggatcagaaactggcgttaaccccaacatacgggccgtcagccacggcgttgtcgcggttaccgtctttacccgacagattcaggtagcgataacccgcctcaatactgactggacgcataatggtgtaacgcgcgccagcattcgcttcttcataactttgaataccgctggagagcgaatccggagagtagtaatactcgccaaacaaacggaagctgttgccaattttccactgcaaaccacctcctaccgctgcggcataaccttcatcgccgtaattcgggttggtgtaaacgccttttccgccaacggtcgccattaacggcccgagaggcagattcaaccccagccccacgccagcgacatcaccgtcgtcgtcgttatgtgtccagttaccgcttaacgccaggcccgtcgtttcagtcccaaaaccgacaccaatattggtgtattctttacccgcctgaccgctgatgctcattgcattgaccgatgcagaaaccaacagcattccggccagacctgctagcgcaatttttttcattatcccctttcccacaagcaattaatcaaaattcccaaagctgcgggattgtactgcctggcacagaggattcaatgagcgaaaaaaaggatctagtcacttattgtaactaaatacttcttaaataattaaatgccgaaaaaataaacacactttatcgatacacacaaaaataataataagtacagttatcatcgcaaaagagattactgtcactttcacatatttgtgagttaccgtattctcatggtttctttttatttataaggaatatccctgtgcgacaacggactattgtatgccctttgattcaaaatgatggtgcttatttgctgtgtaaaatggccgacgatcgcggcgttttccccggtcaatgggcgatttcgggtggcggcgtggagcctggcgaacgaattgaagaggcactacgccgcgaaattcgcgaagaactgggagaacagctgcttttgacagaaatcacgccgtggaccttcagcgatgatattcgcaccaagacgtatgcagatggtcgcaaggaagagatttatatgatttacctgatttttgactgcgtttctgccaaccgagaagtgaaaataaacgaagagtttcaggactacgcgtgggtaaaacctgaagatctggtgcattatgatttgaatgtcgccacccgaaaaacgttacgtttgaaaggtcttctgtaacaatgatgacagccattactggctgtcagattgaaaatttagtggttaacgaattccccatccagataaactttgcctttttccacatgcatgactaaaccatccagataatcaggtttaaatgtcgcgtcacgcttatctttagcaatatatgtcaggcaatgattatgggtgaaaataacgatatttttatcaggcgctttgctttgtaagtccttaattgcactataaatctcattaccgcactgaagaagtcgtttatctaccgtcaattttttacccgctgaaaaccaggtagccgactgaatggtccggacggtattactggaataaagatcgaaatcagggatatcagcactaaaagcgttgcccagttcacgggcatcctgggtacctttaaccgtaatacctgttttatctgacaagcattgattggttgaacggtcgcaacgttcagcatgacgaaacaaaacgacaaccgggtgctgctgtgccagtctggccagtgttttattgtcgatacgtggcaaaccattgctactccaggcggcatgagtacccagtccggcaattgcagcgagcgccagtaaaatgatgatatatttttttgacttcaacgaagagcggcaaaaagctaacacgtaaactccacctatagacaagcgcaaccagacaattaccgtgaaattgagctacatttctggcgataattcgcagttggtgtaatattaaaaatcctacgatgtcggcaaaatgcctcaaaattttgccaaatgcaaagcctaaataagaaaaaatataaaaatttcaatatttacgtctaatattagtttcttaaggttaagttaatattctatccttaaaatttcgctccaaatggcaaaatatacacaacactctttatagcaaatataagtggacaggtattcaatggcggaaggaaaagcaatgtcagaatttttgcctttttcgcgaccagcaatgggcgtggaggaactcgctgcagttaaagaggttctcgaatccggttggatcacaaccggtccgaagaatcaggcgcttgagcaagctttttgccagttgacgggaaatcagcatgccatcgcggtcagttcagccaccgccggaatgcatatcacgctaatggcgttgaaaattggcaagggcgatgaagtgattacgccttccctgacctgggtttcaaccctcaatatgatttccttgttgggtgcaacgccggtaatggtggatgtcgaccgcgatacgctgatggtcacgcctgaagctatcgagtcagccattacgccacgcactaaagccatcattccggtgcattatgccggtgcgccagcagatattgacgccattcgcgccattggcgaacgttacggcatcgcagttatcgaagatgctgcccatgccgtcggtacgtattacaaagggcgacatattggcgcaaaaggtaccgctattttttcatttcatgccattaaaaatattacctgtgctgaaggtggcctgattgtaactgataatgaaaaccttgcccgccagctacggatgctgaaatttcacggtctgggtgtcgatgcctatgacagacaaacctggggccgtgcaccgcaggctgaagtcttaacaccgggctataagtacaatctgaccgatattaacgccgcgattgccctgacacagttagtcaaattagagcacctcaacacccgtcggcgcgaaattgcccagcaatatcagcaagcactggcagctctcccctttcagccattaagccttcccgcctggccgcacgttcacgcctggcatctgtttattattcgtgtcgatgaacaacgttgtggtatcagtcgcgatgcgttgatggaagcgttaaaagaaagaggcattggtaccgggttacatttccgcgccgctcacacacaaaaatattatcgcgagcgttttcccacgctgtcgttaccgaataccgaatggaatagcgaacgcatctgttctttgccgctgttcccggatatgactaccgccgatgccgaccatgtcatcacagcccttcagcaactcgcaggacaataagccatgtttgaaatccaccctgttaagaaagtctcggtggttattcccgtttataacgagcaggaaagcttaccggaattaatcaggcgcaccaccacagcctgtgaatcgttggggaaagagtatgagatcctgctgattgatgacggcagtagcgataattccgcgcatatgctggtcgaagcctcacaagcggagaacagccatattgtgtctattttgcttaaccgcaattacgggcaacattcagcgattatggcgggattcagtcacgttactggcgacttaattattacccttgatgccgatctccagaatccgccagaagaaatcccccgcctggtggcaaaagccgatgaaggttacgacgtggtagggactgtacgccagaaccgccaggacagctggtttcgtaaaaccgcttcgaagatgattaaccggcttattcagcgcaccactggcaaagcgatgggtgattacggttgtatgctgcgcgcctatcgccgtcatattgtcgatgcgatgttgcactgccatgaacgcagcacctttatcccgattctggcgaatatcttcgcccgccgtgccattgaaattccagtacatcatgccgagcgtgagtttggtgaatccaaatacagttttatgcgcctgattaatttgatgtacgacctggtgacctgccttaccacaacgccgctacgtatgctgagtctgctcggcagcattattgcgattggaggttttagcattgcggtgctgctggtgattttacgcctgaccttcggaccacaatgggcggcagaaggcgtctttatgctatttgccgtgctgtttacttttattggcgctcagtttatcggcatgggattactcggtgaatatatcggcaggatctacaccgatgtccgcgcccgcccccgctattttgttcagcaagttatccgtccatccagcaaggaaaatgaataatgaaaaccgtcgtttttgcctaccacgatatgggatgcctcggtattgaagccctgctggctgccggttacgaaattagcgccatttttacccatactgataatcccggtgaaaaagccttttatggttcggtggctcgtctggcggcggaaagaggcattccggtttatgcgccggataacgttaatcatccgctgtgggtggaacgcattgcccaactgtcgccagatgtgattttctctttttattatcgccatcttatttacgacgaaattttgcagctcgctcccgcaggtgcatttaatctgcatggttcgctgttaccaaaatatcgtggtcgcgcgccgctgaactgggtgctggtcaacggtgaaacggaaactggcgttacattgcaccgaatggtgaaacgtgccgatgccggggccattgtggcgcaactgcgcattgccattgcgccagacgatatcgctattacgctgcatcataaattgtgccatgccgcgcgccagctactggaacagacattacccgccattaaacacggtaatattctggaaatcgcccagcgcgaaaacgaagccacctgttttggtcgcagaacgccggatgacagtttccttgaatggcataaaccggcatccgtactgcacaacatggtacgtgccgttgccgatccgtggccgggtgccttcagctatgttggcaatcagaaattcaccgtctggtcgtcgcgtgttcatcctcatgccagcaaagcacagccggggagcgtgatttctgttgcgccactgctgattgcctgtggcgatggcgcgctggaaatcgtcaccggacaggcgggcgacggcattactatgcagggctcgcaattagcgcagacgctgggcctggtgcaaggttcacgcttgaatagccagcctgcctgcaccgcccgacgccgtacccgggtactcatcctcggggtgaatggctttattggcaaccatctgacagaacgcctgctgcgcgaagatcattatgaagtttacggtctggatattggcagcgatgcgataagccgttttctgaatcatccgcattttcactttgttgaaggcgatatcagtattcattccgaatggattgagtatcatgtcaaaaaatgtgatgtcgtcttgccgctggtggcgatagccacgccgattgaatatacccgcaacccgctgcgcgtatttgaactcgattttgaagagaatctgcgcattatccgctactgcgtgaagtaccgtaagcgaatcatcttcccgtcaacttcagaagtttatgggatgtgtagcgataaatacttcgatgaggaccattctaatttaatcgtcggcccggtgaataaaccacgctggatttattcggtatcaaaacaattacttgatcgggtgatctgggcctatggcgaaaaagagggtttacagttcaccctcttccgcccgtttaactggatgggaccacgactggataaccttaatgcagcgcgaattggcagctcccgcgctattacgcaactcattctcaatctggtagaaggttcaccgattaagctgattgatggcggaaaacaaaaacgctgctttactgatattcgcgatggtatcgaggcgttataccgcattatcgaaaatgcgggaaatcgctgcgacggtgaaattatcaacattggcaatcctgagaacgaagcgagcattgaggaactgggcgagatgctgctggcgagcttcgaaaaacatccgctgcgccatcatttcccaccgtttgcgggctttcgcgttgtcgaaagtagcagctactacggcaaaggatatcaggacgtagagcatcgtaaaccgagcatccgcaatgcccaccgctgcctggactgggagccgaaaattgatatgcaggaaaccatcgacgaaacgctggatttcttcctgcgcaccgttgatcttacggataaaccatcatgaccaaagtaggcttacgcattgatgtcgatacctttcgtggcacccgtgaaggcgtgccgcgtctgctggaaatcttgagtaagcataatattcaggccagcatttttttcagcgtcggcccggacaatatgggccgccatctctggcgactggtgaagccacagtttttgtggaagatgctgcgctcaaacgcggcatcgctttatggctgggatattttactggcaggtacggcctggccaggtaaagagattggtcatgccaatgccgatatcattcgtgaagcggctaaacatcacgaagtcggcctgcacgcctgggatcaccatgcctggcaagcccgtagcggtaactgggatcggcaaacaatgatcgacgatattgcacgcggtcttcgcactctggaagagattatcggtcaaccggtaacctgttctgccgctgcgggctggcgtgccgaccagaaggtgatcgaagcaaaagaagcgttccatttgcgctacaacagcgattgtcgtggggccatgccgttccgtccattgctcgaatcaggaaaccctggcactgcgcaaattccggtgaccttacccacctgggatgaagtgattggtcgggatgtgaaagcagaagattttaacggttggttactcaaccgcatcctgcgagataaaggcacgccggtttataccattcatgcagaagttgaaggctgcgcttatcagcataattttgtggatctcctcaaacgcgcagctcaggaaggcgtgacattttgccctttaagcgaactgttatcagagacgttgccgctcggacaagttgttcgcggaaatattgccggacgtgaaggctggctgggttgccaacaaattgcgggtagtcgctgatgaaatcggtacgttaccttatcggcctcttcgcgtttattgcctgctattacctgttaccgatcagcacgcgtctgctctggcaacccgatgaaacgcgttatgcggaaatcagtcgagaaatgctggcatccggcgactggattgtgccccatctgttagggctacgttatttcgaaaaacccattgccggatactggattaacagcattgggcaatggctatttggcgcgaataactttggtgtgcgggcaggcgttatctttgcgaccctgttaactgccgcgctggtgacctggtttactctgcgcttatggcgcgataaacgtctggctctactcgccacagtaatttatctctcattgtttattgtctatgccatcggcacttatgccgtgctcgatccgtttattgcattctggctggtggcgggaatgtgcagcttctggctggcaatgcaggcacagacgtggaaaggcaaaagcgcaggatttttactgctgggaatcacctgcggcatgggggtgatgaccaaaggttttctcgcccttgccgtgccggtattaagcgtgctgccatgggtagcgacgcaaaaacgctggaaagatctctttatttacggctggctggcggttatcagttgcgtactgacggttctcccttggggactggcgatagcgcagcgggagcctaacttctggcactattttttctgggttgagcatattcaacgctttgcactggatgatgcccaacatagagctccgttctggtactacgtgccggtcatcattgccggtagcctgccgtggctgggattactccccggtgcactgtacacaggctggaaaaaccgcaagcattccgcaaccgtctatttgttgagctggacgataatgccgctgctgtttttctccgtcgctaaaggtaaattgcccacctatattctttcctgctttgcatctctggcaatgctgatggcgcattacgctttgctggcagcaaaaaataatcctctggcgctgcggattaatggctggattaacatcgcttttggcgtcactggcattattgccacatttgtggtctccccgtggggaccaatgaacacgccggtgtggcaaaccttcgagagctataaagtcttttgtgcctggtcgattttttcgctatgggcatttttcggctggtacaccttaacaaacgtcgaaaagacctggccttttgccgcgctttgcccgctggggctggcgttgctggtaggattttcaattcctgacagagttatggaaggaaaacatccgcaattttttgtcgagatgacacaagaatcacttcagccaagccgctatattcttactgatagcgtcggtgttgccgcaggtctggcatggagcctgcaacgcgatgacatcatcatgtatcgccagacaggtgagttgaaatacggccttaattatccggatgcgaaagggagatttgtcagcggtgatgagttcgcaaactggcttaatcaacatcgtcaggaggggattattactctcgtgctttcggttgaccgcgatgaagatatcaacagtctcgccattccgcccgcagatgccatcgatcgtcaggagcgtctggtgctgattcagtatcgtcccaaatgatctggctaacattagtctttgccagcttgcttagcgttgccgggcagttgtgtcagaaacaggcaacctgctttgtggcgataaacaaacggcgcaaacatatcgtgctgtggctgggactggcgctggcttgtcttggtcttgccatggtgctctggctgctggtcttgcagaacgtaccggtaggcattgcttacccgatgttaagtctgaattttgtctgggtgacgctggctgcagtaaaactgtggcacgaaccggtatcgccgcgtcactggtgtggggtggcgttcattattggcggcattgtgatcctcgggagtacggtgtaatgggcctgatgtggggattattcagcgtcattattgcctcagttgcgcaattaagcctgggttttgcggcgagtcatctgccgccgatgacgcacttatgggattttatcgcggctctgttagcttttggcctggatgcccggatactgttactcgggctgctgggttatctgctttccgttttttgttggtataaaacgcttcataaacttgcgctaagcaaagcctatgccttgctcagtatgagttatgtgctggtatggattgcttcaatggtacttcccggctgggaagggactttttcgctgaaagcactactgggagtagcctgtattatgagcgggttgatgctgattttcctgcccacgacaaaacaacgttactgagttttccctgccactttacactgccgttcccactcatcggggctataactgcttgccgagaggactttcaccgtatgcagcttttcacgattaatacaataaagcgcattctgcaaaggcgagagtaaatcccccactttcacggcgaagtcactcttcacttcggcgatcatttttatcgcgccgccagcatcgcagagcataagtacatgtctgttatcttgtttattgcagcacgattttttgaccagccattccattgcattatcctgtttgctaagagttttcacatcaatttacagattaacagataaactctttatcaacggcaatggaatggcagaaatgagaagtgaaacggagggttaattattgctgacgttgcacccactcttttagcgcctgacgtgaaattttaataccgccgtttttcagctccggcggcagagttagccagcgcaccggttgttgaaaacgggccagcttatctttcacccattcactaagatcaacgctctcgtggtcatactccatcaccgccaccggtcgatgaccaaactccttgtcggcaacggggacgataaacacctgcaaaaccgcaggatgtgcagcaattacgcgctcgacttcttccggctgaataccctctccgccactgaagaatagattgtctaaacgtccgacaatggtcagcttgccattatgcatctcaccgcgatcgcgcgtagcgtaccagccttcgtcattaaccagtgaaaccagttgcccgttacgccagtaaccttctgccatactggcagcccgcagccacacttcattattaacgattttcacttcccgacccggcagcggcgaaccaacgtctgccaggccgtcggcttctttcgcacacaccgtggaggcaaactcggtcagaccatagccgcaaaagcaacgaatcccctgctcgcgcgcctgttccgtcaactcgaccgggatagccgcgccgccaagtaacaccgctttcagggaaacggaactacggttaaccagcaaacgccagagttgtgttggcaccagtgaagcgtgagtacagcctgccagcatttgctccaatggctgtttatcacgtaccgtcatccgcgcaccagcgtataaccagcgccacataattccctgaccggagacgtgaaacagcggtaaagagagcaaccaatcatcgtgatcgccaaacggaatcagcgataacacaccttgcgcactggcaagatgggcctgataagtatggacagcggctttcggcaaaccggtagaacccgaggtcaacgtcattgagcacagacgcgtcggctgccacgtagcggcatgtgcgccttcaaccagctgaatgtgcagcgacgttaatgccggaaacgtgttttccccatccggcaccagagcaaattgcagcgtcagattgggcagcaattcttcaagcaacggttgcggcagctgagggttcacgggcaacacccgcgccccgcattgcagtaacgccagccaggcgagcagcgtttgcggcgtattccacgcccgcaacatcacgccgctgccctcaaccaccccctgcaccgcaaatccggaggctaattcatcgacgcgagcacaaagctcgcgccagttgagttgctcgtcattaagacgtaaggcgatggtttctccccgcacttgccgccagtgacgccacggccagtcagagaagatcataacaaccgctccagtgcatcaacttccacgacaggcagcgtgctacccggccagcgacgtacctgctgcgcctgcatcagatccagcgtgtccagccctggaatggtgtccggcgttaaccaggcggcaatccgcgccagttgcgttaagcctaagctcgattcaatggaagaactgatcaccgccgtcagccccagcgcgtgcgccgcctgtacctgctcgcgtactttttccagactgcccgtgagcgtgggtttgataactaccgcgcgcacgccctcttcagccacaaaggcaaaatccggctcgcgcaggctttcatcccaggcaatggcaatgccggtttcacgggcaaacgctcgcgaatcatcgcgggttttgcacggctcttcgagaaacgcgatgcggtcgcgataatccgggttaacgtatttggcaaactgctgacctttcagcggtgtccaggcgcgatttgcgtcaagacgcaaatgcagatccggaattgcctccagcaacagattcaccaccatgccgtcgcgcaccgcttcgtacaatcccactttgaccttcgccactttctcgcctggcatatctgcaagtttgaggatcagatcgtccggatcgccattacacagcggtgccgcacggtagttggctgcttgcggcaacgtatctgtcagttctgccaatgcacagcttacgccaaaggccacggaaggcatctgcggtagctcgcaatcgcctgccagccagttatttacccaggcaagcagcacactttgcgcctcttcccaggtttcctgactgaagcccggcagtggggagatctccccccacccttcgcgctcgccttcacgcaggcaaacatacagcccgtcgcgggtttttaaccgcctgtcgcgcagaaccacccccgcgtccatggggatctgccagcggtatacctgcgcgctacgcattacggattccgtttgaatttgctgaagtcaggctgacgtttctggttgaaggcgttgcgaccttcctgaccttcttccgtcatgtagaacagcatggtggcgttgcccgccagctcctgcagccccgcctgcccgtcacagtcggcgttcagtgcagctttcaggcagcgcagcgccatcgggctgttttgcagcatttcgcggcaccaacggacggtttctttttccagatccgccagcggtaccacggtgttcacaaggcccatatccagcgcctgttttgcgtcgtactgacggcacaggaaccagatttcacgcgcttttttctgcccgacgatgcgagccatgtaggaagcgccccagccgccgtcgaaggaaccgactttcgggccagtctgaccgaagatggcattatctgccgcgatagtcaggtcgcacatcatgtgcagaacgtgaccgccgccgatggagtagccagccaccatcgcgacaaccggtttcggacaggtacggatctgacgctggaagtccagcacattcaggtgatgtacgccggaatcatctttatagccgccgtaatcaccacgcactttctggtcaccaccggagcagaacgctttatcgcctgcaccagtcagaatgatcacgccgatgttgtcgtcataacgcgcatctgccagcgcctggatcatctcttttaccgtcagaggacggaaggcattgcgcacctgcggacgattaatggtgatttttgcgataccgtcggtggatttttcataacgaatgtcctcgaaaccttcggagcagtcgtgccattcaaccggtgcgtaaagcattgcttcatcaggataaatcatattgtgtcctttagtcagaaacgcaagatctgcgccagacttgcgattacgccagcgggattttcccgatgcgcgttatgtccggcgcgaggaatgacatggcagtcggcagccagttccgccgccagggcgcggaatttgctgtcacgttcaccacataaataataaaacgcaaatgtgcgggcgctaaggttagcacgtaaatcaggctggacggcgagagaagtcgcctccagcatggcggcaagcgttgcgccattattgttgctgcgcagcgccaccagctcccggcgttgatcgtcattgagtgaggcaaaaacaggctgttgataccagtcggcaaataccgccgttaacggttctgtgagaaaacgctgcacccattggcgatcggaacgctgacgttccgcacgttgttcagcattttgcagccccggatgcccgccttcgacaataaccccacaaagccccgccagcccctggcaagccgccatcatcgccacccgtccaccaagcgagtaccccaccagccagaagtcaaggatgttgtaactaaccaaggttttacgcagtaagtcggtgacatcatcaaatccatcgacgctaatcgccgccgaaccaccgtgacctgggagatcaacatacaaccgtgagtagtcggcaaacgcctcgcccacttcttgccattcgtggcaatcgccggaaaaaccgtgcaaaaacaccagccagggtaaacctggttttccgtgttttgcctgcgcgtgcaggatcataaatggcttacctgcgccagaagttgctggagcgtttgcgcaccatcggtgtcgttaaccaccatttcaatcaccgtggtggttggcgtgcgccaggcgtcggcaaatgccgtttcaagttcctgccagttttgcggacgatgatatttcagctcgaacatcgcggcggcgtgctcaaaatggacgttttgcggcatcagatagaaacgctcacgctcgctttgcggcgttggcaacagcgagaaaatttgcccgccgttgttgttcaccacaattaataccagcggcgcagaaacctgacgcaataacgccagcgcgttgagatcgtaaagtgcggagagatcgcccacaatcgccagcgtcggtttgccgcttgcccgctgaacgccggcggcggtcgaaagcagcccgtcgataccgctggccccacggttgctgtacaccgggtaacctgccggaagttgcgaaagcgcatcaatcagacgtaccaccaggctgttaccaacaaacaattgcccctgttcaggcagatagtcgcagatgcgatgcgccagttgcgcttcgccaaacgcatcacggcgggcaataaccgcctgcattgcctgttccgccaggcgcgggatttcaacgcaccagggctggcgtttttctgccggatgcagctccagccagtcggcaatattggcaattaagcgacgtccgcgatggtgtgccggatcaagtcgcccttcaatgtcatcaacaatccagtactcttctggttcacagcttgcctgccattgcaggagccgtttccccgtcaggctgcttcccagttgcaccacaatttgcgcctgctgcagctcgctggtcgctttggcattgcctaaccaaagatcggcacacggcagcggctgcccggtttgtgacagcacatcgccaatcagcggccagccaagagtttgcgcccacagggcaacttttttgccctcttccgcactcatgcgcccggcaaccaccacgccgcgcttttgtcgccagaagaaccagtcgcgctgtttttcactttccagacgaggcgcttcacgcagccacggtttgtcgtcctgccaccagtcacccagacgctgttgccagctaagcccggtatcgtccatttcgccatacagcggttcagcaaacgggcagttgatatggactccccccgcatgaagcgtaccgagagcgtggtcgatggtagaaaccagccaacgtgcggggatatcctgggtcgggcgcggcaatgaaatactgtgcgtggggtgagaggcgaacattcccggctggcgaattgcctgattcgcgccgcagtcaattagctccggcgggcgatcggcggttaagagaatcagtttttctccggttaacccggcttcaatcagtgccggatagagatttgccaccgccgtgccggaggtcacaatcaccgccaccggctgcttgctgactttcgccagccccagcgccagatgccccaacccacgctcatcgaaatgggtgtggtgaatgaatgcggaattctccgccgccgctaacgttaacggtgtagaacgcgagcctggggcgatacagatgtgtctgacgccgtgacgcgttaatgcttccagaatgaccgccgcccagcgtcggttaaatgcgcttactgacatgagtttgtccggtatcaatattgcggctaagtataaggagctacaaaaatagattattgatatgaatcggtaatgatgcgactcattactattccatttgtaataaagtacgcagccctgccgctttgttgtcgatttcctgccactcttgctcggggtcggaaccacggacaatgcccgcgccagcatataatcgcacgacattgccgctaatttttgctgagcgcagggaaacgcagaattcgctttgttgtaatgagagatagcccgcagaaccggcgtaccattctcgggtgaacggttcgtgacgggcgataaactgtcgcgccagatcgcgcggtaagccagcaactgctgccgttggctgcaactgatgtaaacagatcacatcatccgctttgttgagtgaagtccagatacagcggcgaagatgctgcactttacgcagacgcagtacctgcggcggtaaaacatccagcgtctgggtatcggcctgtaatcgttgacagatatcttccaccaccagcatgttctcgcgctggtttttatcatccgccatcagccactctcctaactgctgcgcctgcttatcatcaggattatttgctactgttcccgccagcgcttcagtacgcagcgctttgtcacgccgccgccataaccgttccggtgaagagccaagaaaagcattttcgccatcaaaggccatgtaaaaatggtagcaattcagattcagtcgacgactggcagccatcatcgccgccgcgttgaccggacttgcgaaatgcaggtcagttgcccgagcgagcaccactttgtcgagctcaccttcggcgatggttttcgttgccagttcgattaattgcgtccagcccgttttgtccggccagtgttgttctcgcgtggtggttaaatgtaacccaggcaagggcttgatactcaccagtgtggcgataaattcttttgcctgaatcgcatcgtgctgaagggagctttcgctgaatagcgtcagccgcagcgtggctttaccgccacagcgtcgccattccaggcggggtaaaagtaaattgccctgcgacgggtcaaaagcattcagcccccaaatgcgtaagtcggcgtgttccgggtgctggcgaagaaaacgttgtgcctggtccaacgacgtaaaacgggtaatcgcgcccaggacgacagcttcttcatcaccattacgttgttgccagtagaattgcgggtatgtttgctgactggccagccagctcaaggcatcaaaagcgtctttgagagggaaaggaatatcgataacccgaatgccgggtgtcgccggaatctcttgcgacaaatggcgcagtagattttccagcgccgtagtaagtgattgcacgcggacctctccctgttaaaagcctcacattatacggggtactacaaaaaaaatgcagtaccccggtgtagggaggttttaacggcgtgccagcaacagtcctagtaccagcccaacggccgcgcccacaccaattccttgccagggtttttcgtggacgtagtcatcagcacgataaactgcctgcttcgcccgatagtaataactgtctgaagcctggctaacccgttttttcacatcatccagcgctttttctgcacgcgctttcagctcaacatatttctgatcggcgggatcgccagaggagcggagcacctcttccagtgtttcactaagcagcgtcaggtcgtcatcgatacgtgtatcaccaaactgattagacattctcgttctccatttgcgtaaaacctgtcactaactatagacaagggttgttgattacgcctgaattacctcgcgtgccatcccaatgtgtgggataccatcttcttcatagacctccgtcacagggataaaaccgaaactctggtagaagttttgcagatgcgcctgcgccccgaggtaaacaggcttatcaggccagtgatgcgtacatgtttcgagtgttttactcatcagctgctgccccactttttcgccacgcaacgcttcactgacaatcacccgacctataacgaccggctcaagatcatcatcacttttcagaatcctcgcatacgccaccagttcatcatttttccaaccgagaatatggcgattatcccccgtcaaatcatcaccatcgatatcctgataagggcaattctgctcgacaacaaacaccgcgcaacgcagttgtaataaggcataaagctgggaaaccgataattcagagtgatgcagatcttgccattcaatcataatgctctccttttagatgtatgccttatactagccggaatattttttgaaacgtgatgaactcatggaattaatttttttaggtacttcagccggtgtgccaacccgcacgcgcaatgtcacggcaatattgcttaacctgcaacatccgacccagagcggactttggttgtttgactgcggtgaaggcacccagcatcagctactgcataccgcctttaaccctggaaaactggacaagatttttatcagtcaccttcatggcgatcatctttttggtttacccggcttgctgtgcagtcgttctatgtcaggcattatccaacccttaacgatttatggtccgcaaggtatccgtgaatttgtggaaaccgcgctgcggattagcggctcatggaccgattatccgctggaaattgtcgaaattggcgctggcgaaattctcgatgatggcctgcgcaaagtaaccgcttatccgctggaacacccactggaatgttatggctatcgtattgaagaacatgataaaccgggtgcattaaatgcccaggcattaaaagctgctggcgtgccgcctggcccactgtttcaggaattaaaagcgggcaaaacaatcacgctggaagatggaaggcagattaacggcgcagattacttagctgctccagtgccaggtaaagcgctcgctattttcggcgataccggcccctgcgatgccgcacttgacctggctaaaggtgtcgatgtcatggtgcacgaagcgacgctggatataaccatggaagccaaagccaatagtcgcggccatagctctacacgccaggctgcgacactagcccgtgaggctggagtcggcaagctaatcattacccacgtcagctcgcgctatgatgacaaaggttgtcagcacctgttacgtgaatgcaggtcaattttcccggcgactgaactggcgaatgatttcaccgtgtttaacgtttaactctgcttattattaaaaacagggcgaaacttgccctgttatcgcaacccgcgctacatatatccacccacacaggcatattgagcgatttttgatatttattcatctccttacgcactatattcagagcaataagttgcctcttttcatcttgattcagcacaacctttgcaactaaaaggagcccatgatggttacagttgtcagcaattattgtcaattatctcaaacgcaactcagtcagacatttgcagaaaaatttactgtgaccgaggaattactgcagtctttaaaaaaaacagcgttatccggagatgaagaaagcattgagttactgcataatattgcgttaggttatgataaatttgggaaagaagctgaagatattctttaccatattgttagaaccccaacaaatgagaccctatcgattatccgacttatcaaaaatgcttgtttaaaattatataatctggcacatatcgcaaccaactcccccctcaaatcacatgattcagatgatctcctgttcaaaaaactattctccccttcgaaattaatgacaattatcggtgatgaaattcctcttatatctgaaaaacagtcgctttcaaaggtgcttttaaatgatgagaataatgaactgagtgatggtacaaacttctgggataaaaatcgtcaattaaccacagatgaaatagcttgctatcttcagaagatcgccgctaatgcaaaaaatactcaagtcaattatcctactggtctctacgtcccctactccaccagaactcacctggaagacgctctcaatgaaaatattaagagcgatccatcatggccgaatgaagtccagttattccccataaatactggcggacactggatattagtttcgctacagaaaatagtaaataaaaaaaataataaactacaaataaaatgcgtcatattcaactcattgcgtgcactaggctatgataaagaaaattcacttaagcgtgtcattaatagttttaattctgaactcatgggagaaatgtcgaataataatataaaagttcatttaaatgaaccagagataatatttttacatgccgatcttcagcaatacttaagccaaagttgcggtgcatttgtgtgcatggcagcccaggaagtgattgaacaaagggaaagcaattctgacagcgccccctatacgttattaaaaaaccatgctgacagatttaaaaaatattcagcagaagagcagtacgaaattgattttcaacatcgactggcaaacagaaattgttatttagataaatatggcgatgcaaatatcaatcattattatagaaacttagaaataaaacactcacaacccaaaaatagagcatccggcaaaagagtgagttaacatcattgttaattaattcgaccagtcagcaaatatgctgactggtcgaacatagtttgctaaacagtcatcactgactgatgtcagtcacaccatccgccagttcaatcaggcgaataaattccgccctgtaaccctgtggatcttccccttttgcctgctgagcccactgtttgatctgctgccaggaggtattgttcaggtattcagaaccgcgtaacttttgcccatatgcagctactgctgcgcgaaaacgcatatcttcagagggcgcgtttattgttggccccagcgggaattcaactaactgactttcttttccctgcgggtatttccagcgaatttttaaccaggccagttctttcgttttgtccgatttcgctaatttgttatccggggcatagcgtaacttatcaattgatgctttttgcccgttcagcgttaattcgaataacaacgttatatgtttgcctgcgcctatatcccctgcatcaacgttgtcgttattaaaatgttccacccgaagttggcgcttttcataaccaatctgacggtattccgttacccacgcggggttaaactcaatttgcgctttgacatcttttgctacggtaatcaacatctgccgcatttcactattcaatactttctgcgcttcagagagggtatcaatgtagctgtagttgccgttaccaacatcggcaattcgcaccatcattgcctcgttgtaattgctattccccacgccaaacgtcgacagagtaacaccagactcccgctgttttttgaccattgattcaatcgattttggatcgtcaatgccaacgttaaagtcaccgtcagtggctaataaaatgcgattgatgccgcccttaataaaccccttcgtcgcctgctgataagccagttccagcccggcaccgccattggtactgccttcggcatccagcgaatcaattgcggcattaatttccgccttatgactcccggagatagaaggcaatgcaatacgggagtcgccagcgtaggtcacgatggcaatgttatcctgctcacgaagttctttgaccaataatttcaacgaagactggataagtggcaaacgttcatcagaaatcattgaaccagaagtgtcgataagaaagaccagattagaagctggtaactcttcacttttgcgatctttcgccaggatatcaactttcagcaatgttcgctgttcattccatggtgcaggtgccaattcgtagcgcatagcgaaaggtattggcttagaggccggaatagattgtttgtctttgatatcccaatcagacgggaaataattgactatctcctccacccgcacagcgtctggcggaggtaacagcccttgattgaggaaacgccttacattcgcataactgccagtgtcaacgtcaagactaaacgtcgccaacggattttgcgctacctgcttaaccggattatcatcgaactgctggtagcgagcggttcctggatttgcgatatgtgtagcttttgctttagccgctcttgcaaatgttggcgcttcctgcaatcgcccctgtaaagcctgtttgtctgaatattgttgcacttcttgctgggccaaggctttcgcggcggcggcgctttgctcagcctcttttattgcagcttgctgcgcggcaagcacttgctgctctgtgggagtactgggttgttgttgctgactttccttattctcaggttgcggcccacatcctgacaaaatcaaactactcataagcaacatgattatatttttatttcgcatataaaatccttttaaataaactcaggcaccagacataaaatatactctttgtataatcctgctaatcttaataaaatacaatatcgaaacccatagcaaataatgattcaacaacgcaacccattaataatttgcatatgaaaaaaataatctttgcttttattatattatttgtgtttttactccctatgattattttttaccaaccctgggtcaatgcattaccgtcaacgccccgacacgcaagtcctgagcaattagaaaaaacagttcgttatcttacacaaactgtgcatccacgtagtgccgacaatattgataatctgaataggtccgcagaatatataaaagaggtctttgtcagtagcggtgccagagttacctcgcaggacgtccccattacgggtggcccctacaaaaacattgttgctgattatggtcctgccgatggaccgctgattattattggtgcgcattatgactctgccagcagttatgaaaacgatcaattgacctatacgccgggcgcggatgataacgccagcggtgtggcaggattactcgaactggcacgtttgttacatcagcaagtaccgaaaacaggcgtgcagctggtcgcctatgcgtcggaagaaccgcccttctttcgtagcgatgaaatggggagcgcggtgcatgcagcttcgcttgagcgtccagtgaaattaatgatagcactggagatgattggctattacgactctgcgcctggaagccagaattacccttacccggcaatgtcctggctttatcccgatcggggagactttattgccgtggtcggcagaatacaggatatcaacgccgttcgtcaggtaaaagcggcattgttgtcatctcaggatttatctgtttattctatgaataccccagggtttattcccggtattgatttctctgaccacctgaattattggcaacacgatattcccgccataatgattactgacaccgctttttatcgtaataaacaataccacttgcccggtgataccgcagacagattgaattatcagaaaatggctcaggtagtggatggtgttataactttgttatacaacagtaaataataaaaatttctcgaggcgggtccagaaaaagcgacatgcacattttattttccctcatctgttttaagatgcgaaacatgaaattcaacggaggaaaaataaatgggaatgattggctattttgcagaaattgactcagaaaagattaaccaactgcttgagtctactgaaaaacctttgatggataatatacatgacacgctttcaggattacgccgactggatattgataaacgctgggattttttacactttgggctgacaggcacctctgcttttgatcccgcgaagaatgatccgctgagtcgtgccgtgcttggtgaacacagcctcgaagatggcatagatggcttccttggattgacctggaatcaggagttagccgcgacaatcgaccgactggaatcactggatcgaaatgaactgcgtaaacagttttccattaagcgactcaatgaaatggagatttatccgggagtgaccttttcagaagagttagaggggcaactctttgcctcgatcatgcttgatatggaaaagctgattagcgcgtatcgacgtatgctgcgacaagggaatcatgcgctgacggttattgttgggtgatatagcttgatgcctgggggagaaagacccattagttaagatttacgccaggatcatcttgaaaaaatctttaaccatggtccggtttttatccccttgtataaatattactaaatgcttgcttagtcgcattgttaaatgcaataccgtatattcggtatgtaacagcgatatcctctgtgctggcaacgatctgtcatgcttgatgaaaacggaattgaacctgtcattaccaggtagataaaaagcctgttcaattttgggattattttttataactcgtgtctgttatggcgacacgggaaaacatcaatattgtccttcacaaattgcagtaatatagaatcaacctctcttgcaagttggtcacaatgtattataagcattttgaatatgtcatcctctgtaatctcgtgaaaattttcggccttgtcttttagctcatcatatcggattcttgcagtaaccattttttgggcgagttctaataaccccaaagcttgcaattgctggtgagtatgatcactttcaaaaaatatcccacactccattccttcccaaccaacatattcatgccattcataaaccagcataaatgtttgtaaaactggcggtaataattggatatctgcaaaaccaaaccaaaacttacgcttgagatcccactcatattcaatcgccaatgctatattgtttaaggcatctccggcatccttatttttacgcaaaatcaattccgtcagtgtatagcgttgttcatcaatacgccgaagagcttctgcaatatcatagtttgtagccaacaaaacattctctgcttcctgatgagtgacgtctgcttttgccgtcaatatattgatttggtcaatatgaaacaacttgatggcttcatcaacatcaccgccagtcctctctaacaaacgtctggcaacctggataccgacaggtacgttcttccgaagtttacgaatttcacttaaccattccatgtcaaacccctttaaatatttatgatattaaatataacaacgtctggataacgacccggcctgactgaatatctcacgttttcctgcttaacattcatgttatgatgctcttgaaactaataatacgtatggaattgtcactatttatctgctaatgaattcaaacaatgtcattcgtttgatgaatatattatttcagggaataattatgacacctttagaacgcattacccaacttgttaatatcaatggtgatgttaataatcctgatactcctcgtccattgttatctcttgaggatttttttattgacaataatatccatggttcaatatgttgcaatgtgattccagaacaatctccgcaagctatctatcaccattttctgaaaatacgtgagcgtaacaatgttagtgatgttttggtagaaattacgatgttcgatgacccagactggccctttagtgaaagtattttagttatcaccactgcttcaccagaagaagttcagagctggtttgtagaagaaattgcccctgatgagtgctgggaaggatggtcagaagatacggagcatggatgggttgaagtccctgtgggtatgcatccggttacttgttggtgggattaaaacatttatataaacagataagcggatgtttacataaatttttatgtgaaggaacatgatgaaacttattcctcgcagtagtgatatttcacctggcattgatggaatttgcccggggccttttcctccgaacggatttaccgtacttacagatgcagcatatggtaacggagactgtttcggtttgtactggcctattggtcaggagcataaactacctatagtgtgcgaaacgtaccatgacgaatggcgaatcgtacctgccttttccagcattaagaagttcgaagaatggctggaagtgaatgatgatgatccccatgaaaatggcatcagcatcgaagatcaagactttgcagcaaatctcttccgtgttgctcggaaatgtctttcaacgggaaggcttgatgacgcactgccactgttacagcgagcaacagaacaattgcctgaagtcagcgaatattggttagcactggcaatccagtatcgccgatgtaaaaaaacagaagctgcagcacaggctgcgcttaatgcttatcttggcaattgggcatttggtgttcctgacaataaagtcattcatttgctgtcacaggccgcagatgtcccgaatttccaggatgatcctgtgattcagtgcattaaagaacaaggattagatcttagctttggaggaacaaaggaaaataataattaccccttgatgcagatgtgtgttgatacttattttgcgcagagaaaaccgcttcaggcattaaccctgttacataattatgcctggataatgtccagtgaaacgactgcatttcaggaacgctatgattttaatatcgatgaatggcgggcaaaattcaggcagttatgtttagagtattttggcgatagtcgtacacagttcacttaacgctctgcgtctatctactatcccttctttttcagaaaaaccgccgagcatgtcggcggctttctgacttacaaagtaacagattacatcagcggcattgccaaacgcacaatgctaatcagcggttgtggccatacacccagcaccagtaccaacagtgcagagatcagcacaacgataccgcccgcgctgtactgccagtttgatggtgcatcgcgacccggttgttccggggcgtgaagatacaggctcaccgccacgcgcaggtagtagtagaggccgattgccgaaccgacaaccacggcacccaccagccaccacaagtgtgcctggacaccgaccgccagcacgtagaacttaccgataaagcccagcgtcatcgggataccggccagagacagcatcatcaccgtcatcactgccgcgaggatcggacgatgccagaacagaccgcggtaagagaacagggaatcagcatccgggccacgatacgggctggacatcaggctgaccacgccgaacgcgccgaggctgctgaacagataaccggccaggtaaacccctaccgcttccatcgacatctcgccggtttgcagcgcaatcagcgctaccagcagatagccgaggtgagagatagatgagtaaccgagcagacgtttgatattggtctggctcagcgccatcaggttaccgaagatgatggaggcaaaggcgataatcgccagcaccacgcgaatcgcttcgctgtcacccaccggtgcgtagaggaacagacgcatcaccacaccgaagatagcgattttgctcgccgtcgccaggaaagtggaaaccggcgcaggcgcgccctggtatacgtctggcgtccacaggtggaacggcaccagagagagtttgaagccgaggccaacaatcatcaggccgaaacctgccagcaacagcggctcgttgagcataccgtcgccaaggtttttacccaacgcgacaaacgacaggtcgccagactgcgcatacaccagcgccataccaaacagcaggaaagaagacgctgcggcagaaaggatggtgtatttgatactggcttccagtgaacgtttctggcggaaagcgtaaccgaccaggccaaacagcggcaaagagatcagttcgataccgaggaacagagacgccagatggttggcattcgccagcaggatcccgcccagcgcggcaattaacaccaacaggtagaactcatccttgttgtcgttatagccttcaagccacgggtaggcgaaagtacaggtggcgaggctcgccaacaataccagcccggtgtaaagcatggcgaaaccatcaacgcgcatcagcggcgtaacgtccatagcgcccgcctggccaacaaaccagagcgaaaccagcgccgcgttaagcccaataaccgagagcgtagcgttgaggaaatgattgcgtcgccacgcaatggagagcatcacaaccaccaccgtcaagccgacgatcagcaacggtagcagtgcgatcaggttttgtggagttattgtcatggcgatttacggccttgtagtagtaacggaattaacaaaccactgctggatattgccaatcgcggagtgcgaggtatccagaatcggctgcggatagaagcccagcagtaccagcagcaccaccagcaacaggatcataaacagctcacgcagcgacatccctggcagttcctggctggcaatctggcttttcgctttaccgaagtaagcgcgatgtaacatcgccagcgaataaacagatgcaaagaccagcccaaaggtagagataacggtaatcaccggtacaacctggaagctgccgaacagaatcataaattcgccgacgaagttaccggtgccaggcatcccaagcgttgccaccgcaaagaacagcgacagtgctggcagccatttcatcttgctccacagaccgcccatcatgcgcatgtcgcgggtatggatacgttcataaagctgaccacaaagaataaacagacccgccgccgacaaaccgtgcgcaatcatctggattaccgcgccctggtaggccaactggctgccggtgtagatagcaatcagcacgaagcccatgtgggaaaccgaggtgtaggcgatcagacgtttgatatcggtctgggcgaaggccatccacgcaccgtagaagatgccgataacacccagccacatagcaattggcgcgaactctgccgacgcgttcgggaacagcggcagggagaaacgcagcaaaccgtaagcggcagttttcagcaagatccccgcgaggtcaacggaaccggcggtcggagcctgggagtgcgcatccggcagccagccatgcagcggaaccaccggcattttgactgcgaaggcgatgaagaagcccagcattaacaggtattccacaccactggacattggcgtattcagcagctcttcatagttgaaggtccagacgccggtcgcattgtagtgaacaaaaaccagcgccaggatggcaatcaacatcaccaggccactcgcctgggtgtaaatgaagaacttggttgccgccgtgatacgcgttttaccgtcagaggctttatgcccccacagtgcgatcaggaagtacatcggcaccagcatcatttcccagaagaagaagaacaggaacatgtcgatggcaaggaacacgccgataacgccgcccaggatccacatcaggttgaggtggaagaagccctgatatttttcgatctctttccacgaacatagtaccgccagcacaccgagcagaccggtcagcacgaccatcagcagcgacagcccgtcaatggcgagatgaatagagataccaaaacgcgggatccacggcatgtcgaattcagactgccactgcggaattccggcggattgcgtcagtgaataaccgccctgcaaccacagttgcagcgacagcgccagcgtcaatcccatggtgatcagcgcgatccagcgtggcaccttgacgccaaagcgttcggtctgccagcacaggaagccgccaataaagggaattaatattagccagggtagtaacatggcgatctttattccttgtaaaagtcccgtcaggaccggattttcaacgaattctcacgacagaaaattctcttcggactgggggtagtgtcggatgcaccgcgaaggcggcttatccgacctacgttcttatatgcccaggggcaatcccacaatccttaactcaacgcagtaccatcaacagtgccagcaccacgaccgcaccgatgctcatggatgccacataccagcgcagatagccgttctcacttaacagcagacctttacctgcaaagcgggaaaggacagccgggatgttcatcattgagttcagcggatcgcgtttcagcaaccaggcaatacccaggaacggcttgacgaacactttgtcatacagccagtcaaatccccaggcgttgtaccaccaggtgcccagcagacggcccggcgcactgttggcgatggaggtcaccagagtacgtttacccagccacagccaggctgccagcagaatgccgaccaccgcgaccacgccagaggtaatttccagggtcaacatgctgccgtgcgccagttccgtcgtttgcggaagcacgccctgcagcggcggtacaatcagtgcgccaacgaaggtggaaaggatcagcagcacaatcagcggcaggctgtgagttacccctttcacggcgtgagcgtgaatttgttcttttccgtggaagacgatgaaaatcatacggaaggtgtagagcgaggtcataaacgcaccgaccagacctgccaccatcagattgatatgaccattcgccatcgcacccgcgaggatctcatccttactgaagaagcccgcagtgaccagcggtagtgccgacagtgctgcgccgcccaccaggaagcagagataaaccagcggaatagatttacgcagaccgcccatcttgaagatgttctgttcgtgatggcaggccagaatgacggaaccggatgccaggaacagcagcgctttaaagaacgcgtgggtcatcaagtggaaaatcgccgcatcccatgcctgcacgccaagcgcgaggaacatgtagccaatctggctcatggtagagtaagcgagaacacgtttgatgtcggtctgtaccagcgcggcaaaaccggccagcagcagcgtaaccgccccgacaatacccaccagatgcagaacttccggcgtcatcaggaacaggccgtgggtacgggcgatcaggtagacacccgcggttaccatggttgcggcgtggatcagcgcggagacaggcgtcgggcccgccatcgcgtcggcaagccatgtctgcaacggcaactgcgcagatttaccgaccgcaccgcccagcagcatcagcgtcgcccacatcagcatgttattgccgtcagcaaagtgcgctggtgccagttccaccatttcgcggaagttcagggtgcccagttcgttgtaaagaatgaacagtgcgaaagcgaggaacacgtcacccacacgggtcacgacgaacgctttcattgccgctgcgccattcttcggatcggtgtaatagaacccgatcagcagataggagcacaggcccacgccttcccagccgaggtacatcagcagcaggttgtcggcaagcaccagaaccaccatgctggcgatgaacaggttggtgtaagcgaagaagcgagagtagccctcttcaccgcgcatataccaggaggcgtacatgtgaataaggaaacccacaccagtgaccaccgagagcatggtcagcgacaggccgtccagcaccaggttaaaaccgatgttaaagtcgcctaccgacatccacgtccacagcggctggctgtatgtctgctcgccgttagcgaagaaatcaacgccgataaaggcggttaccagcgccgccaggcccacagagcctacgccgacgatcgccgagacgttttcagaccagcgcccacgggagaatgccagcaggacgaagccaatcaatggcaaaataatggttaaggcaagcatgttcatccgcgcatctcacttactgaatcgatgttcaggttctggcgacgacggtgaagttgcagcagcagcgcaaggccgatactcgcttctgccgccgcgaggctgatggcgagaatgtacatcacctgaccgtcggtctggccccagtagcttccggcgaccacgaaggccagcgcggaggcgttaatcatgatttccagaccaatcaacataaacagcagattgcgacggataaccagaccggttaagccaagaacgaataagattgccgcgaggatcagtccatgttgtaaggggatcatgcgtgctcctccgtttttcttttcgcgctgtcgtctttacgattgctcagcacttcacccgcacgctcttcacgaccgacgtggaaggccacaaccagacctgcgagcagcagcatagaagccagttccaccgccagtacgtaaggcccgaacagcgtaatacccactgctttagcactgattggcgtaccgtcgataccctgatcgttaacaccgaggatggcgtaaacaatcaccaccagcatgatggccgacaaaattgccggaccaatccacacctgcggtttcagccactggcgttcctgttcgatttctgaaccgcccaggttgagcatcatcaccacgaacacgaacagcaccataatggcacccgcgtagacgataatttccagcgcaccggcgaagtaagcgcccagtgagaagaacaccccggaaatcgccagcagcgaaataatcaggtacagcagtgcgtgtaccggattggtatgggtgatcactcgcaaggtcgcaagtatggctatcaggccacagatataaaaagcgaactccattgcccctctccttacggtaacaggctcttgacgtcgataggcttggcttcgttctctgcttcgcccttatctttgccgtcgattgccatacctgccatccggtagaagttatattccgggtatttgcccggaccggagatcagcagatcctctttctcgtaaaccagatcctggcgcttgtattcccccatttcgaaatccggggttaactgaatcgccgtggtcggacaggcttcttcgcacagaccacagaaaatgcagcgtgagaagttgatgcggaaaaattccgggtaccagcgaccgtctttggtttctgctttttgcagcgagatacagccgaccgggcaggctaccgcgcagaggttacaggctacgcaacgctcttcgccgtccgggtcgcgggtcagaacgatacgaccacgataacggggcggcagatagaccggctcttccgggtacattcgcgtttcgcgtttggcgaacgcgtgcaggccgatcatccagatactacgaacctgggtgccgaaacctactaacaattcttttaaggtcatggtcttattgccccttattgcgcctgccagagaatgacagccgccgttaccagcaagttgatcagcgtcagcggcaggcagattttccagccgaaggacattacctggtcataacgcggacgcggtaacgacgcacgaatcaaaatgaacatcatcataaagaacgcggttttcagcgcgaaccagatgaatggcggtaacaacgggccttgccagccaccgaagaacagcgtcaccatcaatgcagagatggtcacaatcccgatgtactcacccacgaagaacagaccgaacttcataccggaatattcaatgtggtaaccatccgccagttcctgctcggcttccggctggtcaaacgggtgacggtgacataccgccacgcccgcgatggcaaaggtaataaaaccaaagaattgcgggataacgttccacacatgcgcctggctgttgacgatgtcggtcatgttgaatgaaccggcctgcgccaccacgcccatcaaggaaagcccgaggaacacttcgtagctcagggtctgcgcagaagcacgcatcgcacccagcaacgagtatttgttgttacttgaccagcccgcaaacagcaccgcgtaaaccgccagacctgccatcatcaggaagaacaaaatcccgatgttcaggtcggcaaccacccaacccggactgactggcacaatcgcaaaggccagcagcagcgaggtaaaggcaatcatcggtgccagggtaaagatgacgcgatccgagaatttcgggatccagtcttctttaaagaacattttgatcatgtccgcaaccagctggagcgaaccgccccagccaacacggttaggtccgtaacggttctggaacagacccagcaggcgacgttcgccaaagctcatgaatgccccgcaggtgacaaccaccagcaggatcaccaccgctttgaggatggtcagcaggatctcaatcagttccggtgatatccaactcattgttgtgcctccttgagatcctcaagatgcgcgccagccagcaccggagcaatgccggacatacccatcggcaagcccacctgccctgccgtcagtccttcggcgatttcaaccggcagcgtgaccgtgttgccatcgtaactaaaggagacgcgtgtacctgcgttcacacccaacttcgcggcatccgctgggttgagtttgatgtacggctgcggcatacggctctggaagaccggagcacgctgtgacaattcatcgctgccaaacaggtggtaatacggcgcgatacgccatttcccgtcctgcggctggaagcgtgccggtacgctggtgaagtaatccagaccattttcgctggtttcaaacagacgcacgcccggatcgccaaagcgcagtttgccgcccacttcgtcctggaatttgttccacgcctgcggggagttccagcccggcgcccaggcaaacggcacttgcgaacggtgcgcagtcggctggttgttaccttccatcgagaaggtgaacatggtgtcaatatcctgcggctgacgcggctcatgaacgctgatattggcgcgcatggcggtacgaccgctgtaacggtgcggttcacgggccagtttctgcccacgaatacggaatgtcgcatccggcgcagcatctttgatacctgccagttccgggattttcgccacaacagcgtcaatcacatggtcgagctgcgtccagtccacttcacggctcagcagggtgctgtgcagcgagtgtaaccagcgccagctttccagcatgacagttttgctgtcgtaataagcaggatcgtaaacctggaagaaacgttgggcgcggccttcgttgttgatcaccgtaccgtcgctttcagcaaagctggcagcagaaagtaccagatgggcgttttccataatcgctgtgcgttgatgatcaaccaccatcaccagcggtgctttagccagcgcagcattcacgcggatagcagaagcgtgacgatgcagatcgttttccaacaccaccaccgcgtcggcgcgtccggtttccagttcggttaacgcttcttcaagcgaaccgccacccataatgcccagccccatgctgttgacggaacgggcaatcatggtgataccgacgtcagcgccgcgacctttcagggctttcgcgacgttagccgccgcctgaatcacctctaagctaccggcgttcgtcccggagataatcaacggtttcttcgcacctgccagtgcctgcacgatgacgtcgattttgctttgcagctcaggttcgataccgtcaaccgctggtgcagagttatccagcgcatgggcgatggcaaaacctaaacgcgcctgatcttcaaccggtgcgcggtaagtccacgccgcgatatcatccagacgggtgtcatcaacgttggtaacaaacagcggatgcttcgcacgttgaccgatgttgaggattgccgcaatctgccagtcagccactttctgtgctgccgccatttcgcgcgctttacctttcacagcctgacgcactgccagcgcgacgcgcgcgccggtctgggtaacgtcttcgcccagcaccagtaccgcatcgtaagattcgatttcgcgcagagccggagtataaatgccgccttcacgcagcactttcagcgccagttgcagacgttcctgctcaccgtgagcgataccggtgtagaagttttcttcgcccaccagttcacgcagcgcaaagttgctttccacgctggcacgcggagaaccaataccgatcactttcttcgactgacgcagaatatctgccgcgccctgcattgcctgttcggcgttgagggtaatgaaatcatcgccacgacgctgtactggctgacgcggacgatccttcaggttgacgtaaccgtaaccgaaacgaccacggtcgcagaggaagtagtggtttaccgtaccgttgtaacggttttcgatacgacgcagttcgccgtaacgttcaccggggctgatgttacagccgatggaacattgctggcagatgctcggcgcaaactgcatatcccatttacggttgtaacgctcggagtgcgttttgtcggtaaatacgccggtcgggcaaatttcgaccaggttaccggaaaattcgctttccagcgtgccgtcttccgggcgaccgaagtagacgttgtcgtgcgcaccgtaaacgcccagatctgtaccgtcagcgtaatctttgtagtaacgcacacagcggtagcaggcgatgcagcggttcatttcgtgagagatgaatggccccaaatcctgattacggtgggtacgtttggtgaaacggtagcgacggaagctgtgtccggtcatcacagtcatatcctgaagatggcagttaccgccctcttcacataccggacagtcgtgcgggtggttggtcatcaaccactcgaccacgctttcacggaactgtttcgcttcttcgtcgtcaatggaaataaaggtgccatcggaagccggtgtcatacaggacatcaccaggcgaccacgcgtgtcttccgcgttttggtattgcttcaccgcacactggcggcaagcaccgacacttcccagcgccggatgccagcaaaagtaaggaatatcaaggcccagagacagacaagcttccagcaggttgtccgctccgttgacctcgtattctttgccgtctacatgaattgtagccattagcatgcttccagttttctcagtcagagactgagcgttaatcgaaattcggttaccagcgctctttcagcaggttcggctgaatcccattaatcaaatgggtattgctgaacggctgtttgattcccgcctcaaattcttcgcggaaatatttgatggcgctctgtaacggctccactgcaccaggtgcgtgggcacagaaagttttacccgggcctaagaatcgacacagttgctcaagtgtttcgatatcgcccggctgaccttcaccacgctccagcgcacgcagaattttcacgctccacggcagaccgtcgcggcacggcgtacaccagccgcaggactcacgggcgaaaaactcttccaggttacgcaccagcgacaccatgttgatctcatggtcaaccgccatcgccagcgccgtacccagacggctgcccgctttaccgatactttcgaattccatcggcagatcaaggtgcgcttcggtcaggaagtcagtccccgcgccgcctggctgccaggctttaaatttcagaccatcacgcataccaccggcgtaatcttcgaggatctcgcgtgcggtggtgccgaacggcagttcccacagtcccggatttttcacccgaccggagaagcccatcagcttggtgccagcatctttacttttcgagatgttctgataccactccacgccgttagcgaggatcgccggaacgttacacagggtttcgacgttgttgacacaggtcggtttaccccatgcgccggaggttgccgggaagggtggcttcgagcgtgggttagcacgacgtccttccagggagttgattaacgctgtttcttccccgcagatgtagcgccctgccccggtatggacgaacagttcgaaatcgaaacctgttcccataatgtttttgccaagcagacccgcttcggtggcttcggcaatggcacggcgcagattaactgccgcttcgatatattcgccacgcaggaagatgtagccacggtaagctttcagcgcaaacgcggagatgagcataccttccaccagcaggtgcggcagttgctccatcaacaggcggtctttataggtgcccggctccatttcatcggcattacacagcaggtaacggatgttcatggattcgtctttcggcatcaggctccatttcaggccagtcgagaagcccgcgccgccgcgccctttcagaccagcgtcttttacctgattaacgatttcgtccggagacagcccggtcagcgccttacgcgcgccttcgtaaccgtttttgctgcggtattcgtccagccacactggctgtttgtcatcgcgcagacgccaggtcagcggatgcgtttcgggagtacggataatgtttttcatttataccgctccagcagttcagggatcgcttccggggtcagatgcgcgtgagtgtcctcatcgatcatcatgtttggccctttatcacagttccccaggcagcaagttggcagcagcgtaaagcggccatcaaatgtcgtttgccctggtttgatgttcagctttttctcgagcgccgcctgaataccctgataaccgttgatatgacagaccacgctgtcacaataacggatcacatggcgaccaaccggctggcggaagatctgactgtagaacgttgccacaccttcgacgtcgcttgccggaatacccagcacatcggcgatcgcgtggatcgcaccatccggcacccagccacgctgcttctgaacgattttcagcgcttcaatggacgccgcacgcgggtcttcgtagtggtgcatctcgtgctcgatcgcttcacgctctgccgcactcagctcaaaagcctcggtttgtggttgttgattctcgtgcataattagcggtccacatctgacataacaaaatcgatactgcccagataaacaatcaggtcagacaccaggctgccgcggatcgccgccggaatttgctgcaaatgcgcaaagctcggggtacgaacacgggtgcggtaactcatggtgctgccgtcgctggtcaggtagtaactgttgatccctttggtcgcctcaatcatctggaaagattcattggcaggcatcaccggaccccacgacacttgcaggaagtgggtgatcagggtttcgatatgttgcagcgtgcgctctttcggcggcggcgtggtcagcgggtgatccgctttgaacgggccttccggcatgttgttgaggcactgctcaagaatgcgcagactctggcgcagctcttccactttaagcattacgcgggtgtagcagtcagaaacgccaccacccaccgggatttcaaagtcgaagttttcatagccagaataaggacgcgccttacgcacgtcgaagtcgatcccggtagcacgcaggcccgcgccagtggtgccccactccagcgcctctttcgcgccataggcggcaacgccctgggaacgacctttcagaatggtgttttgcagcgccgctttctcgtaagacgccagacgtttcggcatccagtcgaggaactcacgcagcaggcgatcccagccgcgcggcaggtcgtgcgctacgccgccaatacggaaccacgccgggtgcatacggaaaccagtgattgcttccaccagatcgtaaattttctgacgatcggtaaaggcgaagaacactggcgtcattgcgccgacgtcctgaataaaggtcgagatatacagcaggtgactgttgatgcggaacagttcggagagcataacgcgaatgacgttaacgcgatccggcacggtgatcccggccagtttctctaccgccagcacgtaaggcatttcgttaacgcagccgccgaggtattcgatacggtcagtatacggaatgtagctgtgccaggactggcgttcgcccattttctccgcaccacggtggtggtaaccgatgtctggtacgcagtcgacaatctcttcgccatcgagttgcaaaacgatacggaaagccccgtgcgccgacgggtggttcggaccgaggttgaggaacatgaagtcctcgttttcggtgccgcgcttcatcccccactcttccggtttgaaggtcagggcttccatctccagatcctgtttggctttggtcagctcaaacggcgagaattcggtagcgcgcgccggataatctttacgcagcgggtgacctttccaggtttgcggcatcatgatgcgtcgcaggttcgggtgaccgtcgaaagtaatgccaaacagatcccaggtttcacgctcataccagttagcgttcgggaacagtttggtgaaggtcggtacgtgcaggtcgttttctgccagcgccaccttcagcatgatgtcgcggttacgatcgatagaaatcagatggtagaaaacggaaaaatccgcggcaggtaacccttcgcggtgtgtgcgcagacgttcgtccatgccgtgtaagtcaaacagcatgacgtaaggtttcggcagtttctttaagaaatcgccaacttccagtaattgttcacgcttgatccacacaacgggaaccccggtgcgagtcgcctgaacagtaaaggcatccggcccaaaacggttgcgcagttcgccaatcaccggatcatcaagatgatcgcgggtctgccaggcgggttcttgcgcggttaagtcggtcatattgttcaccattgcaaatggtccgtggtgactgtcggcgcagtaagcttcgcgaaatagatttaggaataagcgaagaaaaatccctttgccgacaggcgcaaattaaatctcgtcaggtgtacgcaggttagttacggcaatgcgttcaccgcgcttgcgttcgcgctctgattgcatattggcgcgataaacgccctgatcgccaaccacccaggagagcggacgacgttctttgccgatagattcctgcaacagcatcagtgcctgcatgtacgcttcaggacgcggcgggcagcccgggatatacacatcaaccgggatgaatttatcgacgccctgcacaacggaataaatatcgtacataccaccagagttggcacaggcacccattgagataacccattttggttccagcatctggtcatacagacgctgaataaccggtgccattttggtaaagcaggttcctgcaaccaccatcaggtcagcctgacgcggcgaagcacgcaatacttctgcgccaaaacgcgccacgtcatgcaccgcggtaaacgaagtcaccatctcaacgtaacagcaggaaagaccgaagttatacggccaaattgagtttttacgaccccagttaaccatgtcattgagcttgcccataaacacgtttttgttaacttcttgctccagagggtcggttacgatctcctgcttttgcagggggtaacggtcgttctcaccgttgggatctatgcgggtgagcgtataatccatcttaatgcctcgcggttagcgttgacgattagcgatactgttcgtttccgggttcatacgctcgcggcgtgaacgcgcgggcgtccagtccagcgcgccaatacgcaccagataaaccagacctgccagtaacacaaaaataaaaattgcagcttccacaaagcctacccagccgctttcgcggatagaggttgaccatgcgaacagatacagcgcttcaacgtcgaagataacgaagaacatggccaccagataaaacttggcggacaggcgtaagcgggcggagccgaccgagtcgataccggattcaaacggcacgtttttcgacctcgcgcgtgcgcgaccgcctaaaaaccaaccgcctaccagcatcaggcaacacaggccaatggcaacgataagaaagatagcgaatgcccagtgatgagcgatgacttcagtggatgttgacatactcattgcttactcatcaaaagtagcgccagattcactgctcttcacggcagatggacgccacatcgattcatggggaggaataaaaaaaaccttacaatcactgtagaaattcttttatacagctaattgatgtggttttttactcctttctataaccttttgtcaactttaacaaaagtttcttcacattagtttacataatatcaacaccattagcatttaatgccctttcaccccagatccttgacgactccaggataattagatgttgttgaatcgtgtccgttgtgaagcaatggaaaaaatacgggtctattttgacaggaatttgtgtcgattcctccccccaaaagagagtattttcttgatctgtgacacgcttttgtcattccataacaaaaacgcagcaacaaatttacgtattttttaacatcattgtagcaggtgatttttttcaggcgattatttgtgcgttcgggacgtgaatctctggtggttgaaaaatgaacagttttgtacgttctgcactatgcgatgaaggatttttactaaaaaaaagccgctggggtttaaaacacccccagcggctcgttttttacactattgtctcaggaattatctatcgtccgtcgattactcgatatccctttcaatcaacaatgaatcatccccttccggagcagacattgggctgtattgccacggattatggtagctctccatcgcctgatagatcacctgggccagctcattattactggacggatcatagcacagcaaatattcggtatcaggtagcggcggtaagccatctactccactcagcacacgcaggtccgggctcatcatctcaaccggccttgccgtcacgccaagaccggctttcactgccgcacgaacggccggaagcgtcgaggcgacataagccagtcgccatggaatatctgctttattaagcgtcgccagcaccatatcgcgaaacgggctaggatcatccagcaatacaagagggatcggctcgcctttttgcaatatgtattccgctgcgcagtaccagtgtgttggcgaggtacgcaggttcaatgccttaaacgctgaaggacgatgggtggttaccatcaaatccacttcctgggattccagcatttctgccatataggcattacgtttaacgcggacatccagcgctaatttcggataaaccgaactcacgcgatttaacaggaaaggtaagatcgtatcggcagattcatctgaagcaccgatagttaatacgccctgaagattactgaacattaatgatgagcaggcctcatcattaaaacgcaggattttcctggcgtaaccaagaagttgaatgccatgttcagttaacagtttgttgcgaccgtgacgagcgaacagttctttcccaacgagttgttccagacgctgcatttgctgacttacggcggactgagtacgacacacagcggcagctgcggcagcaaaagtgttcagatcggcaacagcaacaaatgttctcagcagatcgaggtcgaggttaattatcggacgatttgcacttatcatatattatcacttactggcggctcatactgagctggttaatgctgtgcacacacaaacaagcaattccatttgtaatgtgcctccctggcagtttcatccggaacccggacgaaagtaaaaatgcatatgagttgcactaaaaaagcgactcacattgttccgttataatgcctgaagtagatcacagaatatatcttcagggatcgcatatctattaagttactcactcttttctatttatgacatgcgcgtgtttgtataaatgtaaatgtgagtccttgttccactctcgtgcagcatcgctggtcatacgcgaacacgtaccaacagcaatggtgaggcggcatcaagagcagggatccgtcatttatccgagcattttaccccaaaaaccttttatttataagggtcattgcgaattatctgatgcaaagttatgttatgttaggcaaagtaatcttctattattaataagcacatcaaaacctttttgaatattaaataataattaattagcatcatcctcattcattaattccgcttaacaatagtttcacaccttgcccccattgcgacacctcggaaatcatcacgcagttaaactctccgtaatgaggaaatatcatcatcgcgtttcattagtgaattcttaaatgaggcattttcacacaattatcttacagataaaaaaaccagacttacaattaagaatcagaacaattcactatataacattgcatgtaaagcatatacacctcattattttgtcattattaagttattaacagcacaatcgagccttcccctctggcaaaatcttattctgcagaccttcaaaacaccgtcctgggggagtacattgttctaagctgacttccacggcagggagtggcgataacagcaaaaaaggtcaagattcatgtcccccattgaaaaatccagcaaattagagaatgtctgttatgacatccgtggtccggtgctgaaagaagcaaaacgcctggaagaagaaggtaacaaggtactgaaactgaacatcggcaacccagccccgttcggttttgacgcgccagatgaaatcctcgttgacgtgatacgcaacctgcctaccgctcaagggtattgcgattccaaaggtctttactccgcgcgtaaagccatcatgcagcactaccaggctcgtggcatgcgtgatgttaccgtggaagatatttacatcggcaatggtgtatcggagcttatcgttcaggcaatgcaggcattgctgaacagcggggacgaaatgttggttcctgcaccagattacccactctggaccgcggcggtttcgctttccagcggtaaagcggtgcattatctttgcgatgaatcctctgactggttcccggacctcgatgatattcgcgctaaaattacgcctcgtacgcgtgggatcgttattatcaacccaaataacccaaccggcgcggtatattccaaagagcttttaatggagattgtggagattgcacgtcagcataatctcattatcttcgccgatgaaatttatgacaaaattctctacgacgacgctgagcatcactcaattgcgccgctggcacctgacctgctgaccattacctttaacggactgtcgaaaacgtaccgcgttgcaggcttccgtcaggggtggatggtgttgaacgggccgaaaaaacacgccaaaggctacatcgaaggtctggaaatgctggcttcaatgcgcctgtgtgctaacgttcctgcgcaacacgccattcagaccgcgctaggtggttatcagagcatcagtgaatttattacccctggcggtcgtctttatgagcagcgtaaccgcgcgtgggaactgatcaacgatattccgggcgtttcctgcgtgaaacctcgtggtgcgctgtatatgttcccgaaaatcgacgccaaacgctttaacattcacgacgatcagaaaatggtgttggatttcctgttgcaggaaaaagttctgttggtgcaagggacggcattcaactggccgtggccggatcacttccgcattgtcacgctaccgcgtgtcgatgatatcgagctgtctttgagcaagttcgcgcgtttcctttctggttatcatcagctgtaatcttaatttcactgccggagattgcatccggcagcgttatcccgccacaatgacctgatgatgtcatcatacgtaaggtcactatgaaacagagccatttttttgcccatctctcccgcctgaaactcattaaccgctggccgctcatgcgcaacgtgcggacggaaaatgtgtccgaacacagtttgcaggtagcgatggtcgcccatgcgctggcagctatcaaaaatcgaaaatttggcggtaatgtcaacgccgaacgtatcgctttactggcgatgtaccacgatgcctcagaagtgctcaccggcgatctccctactccggtgaaatacttcaattcgcaaatcgctcaggagtacaaggctattgaaaaaatcgctcagcaaaaactggtcgatatggttccggaagagctgcgggatatctttgcgccgttaattgacgagcatgcatatagcgatgaagaaaaatcgctggtgaaacaggcagatgcactgtgtgcatatctgaaatgtctggaagaactcgcggccggaaataatgaattcttgctggcaaaaacgcgactggaagcgacgcttgaagcgcgtcgcagccaggagatggactacttcatggaaatatttgttcccagcttccatctttcgctcgatgagattagccaggattcaccgctgtaagcagccggagtctgcgtcgcatcaggcaataagcgccggatgcgacatcaggctcttgtcaaaacggaaacagcatcgggatcatcaccacacaaaccgccatcacgataatggtgaacggtacccccaacttcacaaagtcactgaagctgtaatttcccggacctaaaaccagtgtgttaacaggtgaagaaaccggtgtcataaaggcggcggatgctgccatcgccacgaccatcgcgaatggataaggcgacacccccatcgttttggcagcagccagcgcaatcggagccatcaacaccgccgtcgcggtattagagataaatagcccaataaccgccgacaagacaaacaaacaccccagcatcatatgtggcccgtaaccaccgccaatgtccatcagccctttcaccgccagcgcgacacctcccgttttctgtaatgccacagcaaacggcatcatcccaacgatcaaaataatgctcggccagtgaatggatttataggcgctttcagcatctatacagcggaatttccccatcagcaggcaggcgatgatagcggcaacaggattaggaatttcatctgtcagcattaacgccaccattagcaccagacagaaaatggcatggggtgcctggctgtgcgcgggtgatgcttcactcacctcttccggtaagttcagcgctacgaagtcgcggccctgtttggccagcataccgatcagtttccagttacccacaaccaggatgatatcgcccagcagcagaggctcatccgccagcgaaccttccagcgccacgccattgcgctttagccccaccacattcagtccgtagcgggtacgaaaaccaatttcgcgcaccgatttaccaatcagttctgactcaggaattaatgaaatctctgccatgcccacatcaagggcctggtcagaaaaatactcgccgcgcagtaccatcggctccagcaattgctcactacaaaattgccggagatcgacatcagccgcagacatatcaataagcaaaacgtcacgcgcgcgaaattcagaaaccccattaacgttcacgataacgcgacgaaaacgccgccagcgttcaacaccgatgacgttagcgccataacgctcacgtaatttgagatcatccagccgttgaccaatcattggcgatccggggcgaatagccagacgtcgcgcacgcccggtcagtcgatattcacggataagatcgcgaaaggttcgacgcgtccagccttcgcgctgcggggtctgggtatcccctttcagcatgaaacgcatcactaacatatacaaaatacccagcaccagcacgaccaggccaataggtgttacgctaaagaaactgaagccgtgatagccttcacgcagcaattcactgttgactaccaggttcggcggcgtcgccaccagcgtcatcatgccgctaatcagcccggcaaaacttaacggcatcatcagacgtgacggcgacgtttgcatacgcatggcaacgcttaacaccacgggaataaagatagcgacaacgccggttgaactcataaacgcgccaagccccgcgacggtcagcatcaacaaaaccaacattttgatttcactattgcccgcaactttgaccagccatgttcccattacggtggcaacaccggtacggaccaaaccatcgccaataataaacaaggcggcaatcaggacaacgttaggatcagaaaagccggaaaatacttctgggactgtcagcgttccgcttaatgcaaacgcgacaataacaaacaaagcgaccgcatccatacgcactctgcccgtcgcaaacaagacgatggcaacggccagtaatgaaagaacccaaatcaattcaccgttcacaacttatccttgttaattgagggggatgacttgattctgccataaaaaagccccgacgagacggggctaaatcatgatcaggtgtttcactgaataataacatcgccatttggctgtttggtcacagtaatttgctccagactgtggaggaccaaatcgacctcattcaggcgcggggtatctgccggagcgttaaccgcaatgacatgacaacccgccgccaggccagaaagcacgccagcgggagcatcttccaccaccacacactcctgcggcgcaagccccagcagctgcgcgcctaacagatacgcatcaggttctggttttccgcgcttcactcgctcagcggttacaaacacctctggtgcgggaagcccagctattttatggcgcgctcgcgctaccggcatggagccagaagtcacaatggcccacggaatacctgctttattcaaatgactgagtaaggcgattgcccccggaagcgcggtaataccttcggtttccgtggcctcgatgtgctccagacgcgtaaactcggcggcaatatcagcctcggatttgcccgccataaaatggcgcagagaggtgatcgcctgtttaccgtgaatgaaagccagcacctcttccggcgctaacccatgacgtctggcccagttgctccacgcccgttctaccgcaggcagggaatccaccagcgttccatcaagatcaaacagaaaacctttgcaccgcacgcgggcctcctcaggcattgataatttgattaatttcgttggcgctcaaatggtactgacgcgggcaggcatgccacacattaagcatgcgctgatatttttcccacattggcgtctgggcgttaaaaccgtgagttccggcgtcaaaatgggtatagcgcccttccacattaaccataaagcggacataaccgaggtaacgtgcttcagtggcggcgtcaaagccgaggaaggtgacacgacgttcatcgatggattgctggtcctgcaaattagaccaggaaacatgcaacgcatgatacatctccataatgtcgatgatagtgcggcaggtttcttctttcagctcgccaaactcgcgatccaattcacgcatctgtaatccgtaaccacgctcaataattgtttgcaggcgacggtaacgttcagcatttgccggatcgagcatagtcatcatcttgtactgattagacaaaataagacgttgcgcgttggtcatttccattgttgactcctgtatcactctactacggtgaaaaaaaagaaggctgagtatgccttcttttatatgcgtaatcaggggtcaattacaaatcatcaaggaaagttttatccagttgtttgaaggcgcgcttaagcgtgtcagctaatgcctggtaatcaggcttgccttcaacgggtgccaacacctgtccagactcctgcaatttaccgcgaacttcataaaaccagttaaggattgcagggggtaatggcgtgacagaacgcttgcccagccaccacaatccctgcatgggtaaacttaaggcgaacagggcagtggcaactgccggcccaagctgaccgcccagggcaatctgccagcagagagtaaatacggcgatcggcggcataaaacggatcgcataacgcgtcatcttgataacgcgattttcgacaaagaccggggcaaggcgtttttccagcggccacgtctttgagtaatgctgtccccggcgaaacaagctaaaaaaattaacagaacgattatccggcgttgacatgcttcacctcaacttcacatataaagattcaaaaatttgtgcaaattcacaactcagcgggacaacgttcaaaacattttgtcttccatacccactatcaggtatcctttagcagcctgaaggcctaagtagtacatattcattgagtcgtcaaattcatatacattatgccattggctgaaaattacgcaaaatggcatagactcaagatatttcttccatcatgcaaaaaaaatttgcagtgcatgatgttaatcataaatgtcggtgtcatcatgcgctacgctctatggctccctgacgtttttttagccacgtatcaattataggtacttccatgtcgagtaagttagtactggttctgaactgcggtagttcttcactgaaatttgccatcatcgatgcagtaaatggtgaagagtacctttctggtttagccgaatgtttccacctgcccgaagcacgtatcaaatggaaaatggacggcaataaacaggaagcggctttaggtgcaggcgccgctcacagcgaagcgctcaactttatcgttaatactattctggcacaaaaaccagaactgtctgcgcagctgactgctatcggtcaccgtatcgtacacggcggcgaaaagtataccagctccgtagtgatcgatgagtctgttattcagggtatcaaagatgcagcttcttttgcaccgctgcacaacccggctcacctgatcggtatcgaagaagctctgaaatctttcccacagctgaaagacaaaaacgttgctgtatttgacaccgcgttccaccagactatgccggaagagtcttacctctacgccctgccttacaacctgtacaaagagcacggcatccgtcgttacggcgcgcacggcaccagccacttctatgtaacccaggaagcggcaaaaatgctgaacaaaccggtagaagaactgaacatcatcacctgccacctgggcaacggtggttccgtttctgctatccgcaacggtaaatgcgttgacacctctatgggcctgaccccgctggaaggtctggtcatgggtacccgttctggtgatatcgatccggcgatcatcttccacctgcacgacaccctgggcatgagcgttgacgcaatcaacaaactgctgaccaaagagtctggcctgctgggtctgaccgaagtgaccagcgactgccgctatgttgaagacaactacgcgacgaaagaagacgcgaagcgcgcaatggacgtttactgccaccgcctggcgaaatacatcggtgcctacactgcgctgatggatggtcgtctggacgctgttgtattcactggtggtatcggtgaaaatgccgcaatggttcgtgaactgtctctgggcaaactgggcgtgctgggctttgaagttgatcatgaacgcaacctggctgcacgtttcggcaaatctggtttcatcaacaaagaaggtacccgtcctgcggtggttatcccaaccaacgaagaactggttatcgcgcaagacgcgagccgcctgactgcctgatttcacaccgccagctcagctggcggtgctgttttgtaacccgccaaatcggcggtaacgaaagaggataaaccgtgtcccgtattattatgctgatccctaccggaaccagcgtcggtctgaccagcgtcagccttggcgtgatccgtgcaatggaacgcaaaggcgttcgtctgagcgttttcaaacctatcgctcagccgcgtaccggtggcgatgcgcccgatcagactacgactatcgtgcgtgcgaactcttccaccacgacggccgctgaaccgctgaaaatgagctacgttgaaggtctgctttccagcaatcagaaagatgtgctgatggaagagatcgtcgcaaactaccacgctaacaccaaagacgctgaagtcgttctggttgaaggtctggtcccgacacgtaagcaccagtttgcccagtctctgaactacgaaatcgctaaaacgctgaatgcggaaatcgtcttcgttatgtctcagggcactgacaccccggaacagctgaaagagcgtatcgaactgacccgcaacagcttcggcggtgccaaaaacaccaacatcaccggcgttatcgttaacaaactgaacgcaccggttgatgaacagggtcgtactcgcccggatctgtccgagattttcgacgactcttccaaagctaaagtaaacaatgttgatccggcgaagctgcaagaatccagcccgctgccggttctcggcgctgtgccgtggagctttgacctgatcgcgactcgtgcgatcgatatggctcgccacctgaatgcgaccatcatcaacgaaggcgacatcaatactcgccgcgttaaatccgtcactttctgcgcacgcagcattccgcacatgctggagcacttccgtgccggttctctgctggtgacttccgcagaccgtcctgacgtgctggtggccgcttgcctggcagccatgaacggcgtagaaatcggtgccctgctgctgactggcggttacgaaatggacgcgcgcatttctaaactgtgcgaacgtgctttcgctaccggcctgccggtatttatggtgaacaccaacacctggcagacctctctgagcctgcagagcttcaacctggaagttccggttgacgatcacgaacgtatcgagaaagttcaggaatacgttgctaactacatcaacgctgactggatcgaatctctgactgccacttctgagcgcagccgtcgtctgtctccgcctgcgttccgttatcagctgactgaacttgcgcgcaaagcgggcaaacgtatcgtactgccggaaggtgacgaaccgcgtaccgttaaagcagccgctatctgtgctgaacgtggtatcgcaacttgcgtactgctgggtaatccggcagagatcaaccgtgttgcagcgtctcagggtgtagaactgggtgcagggattgaaatcgttgatccagaagtggttcgcgaaagctatgttggtcgtctggtcgaactgcgtaagaacaaaggcatgaccgaaaccgttgcccgcgaacagctggaagacaacgtggtgctcggtacgctgatgctggaacaggatgaagttgatggtctggtttccggtgctgttcacactaccgcaaacaccatccgtccgccgctgcagctgatcaaaactgcaccgggcagctccctggtatcttccgtgttcttcatgctgctgccggaacaggtttacgtttacggtgactgtgcgatcaacccggatccgaccgctgaacagctggcagaaatcgcgattcagtccgctgattccgctgcggccttcggtatcgaaccgcgcgttgctatgctctcctactccaccggtacttctggtgcaggtagcgacgtagaaaaagttcgcgaagcaactcgtctggcgcaggaaaaacgtcctgacctgatgatcgacggtccgctgcagtacgacgctgcggtaatggctgacgttgcgaaatccaaagcgccgaactctccggttgcaggtcgcgctaccgtgttcatcttcccggatctgaacaccggtaacaccacctacaaagcggtacagcgttctgccgacctgatctccatcgggccgatgctgcagggtatgcgcaagccggttaacgacctgtcccgtggcgcactggttgacgatatcgtctacaccatcgcgctgactgcgattcagtctgcacagcagcagtaatctcgtcatcatccgcagctttgcgctgcggatatctgaaccggaaataatcactatttccggttttttattctcttaatttgcattaatcctttctgattatcttgcttaactgcgctgcatcaatgaattgcgccatcccactttgcatacttaccactttgttttgtgcaagggaatatttgcgctatgtccgcaatcactgaatccaaaccaacaagaagatgggcaatgcccgatacgttggtgattatcttttttgttgctattttaaccagccttgccacctgggtagttccggtggggatgtttgacagtcaggaagtgcagtatcaggttgatggtcaaacaaaaacacgcaaagtcgtagatccacactcatttcgcattctgactaacgaagcaggcgaacctgagtatcaccgcgtacagctgttcacgacgggcgatgaacgcccgggcctgatgaacttcccgtttgaaggattaacctcaggatcgaaatacgggacagccgttggcatcatcatgtttatgctggtgattggcggcgcgtttggcattgtgatgcgtacaggaaccattgataacggtatcctggcgcttattcgccatacccgcgggaatgaaattctctttattcctgcgctgtttattctgttttcacttggcggcgcggtatttggtatgggagaagaggccgtcgcctttgccattatcatcgcaccgctaatggtccggctgggctatgacagtattaccaccgtcctggtgacctatattgccacgcaaatcggttttgccagttcgtggatgaacccgttttgtgtggtcgttgctcaggggattgccggcgttccggtgctttctggctccgggttgcgcatcgtggtgtgggttatcgccactctgattggcctgatctttaccatggtgtacgcctcacgagtgaaaaagaatcctcttctgtcacgcgtgcatgagtccgaccgcttctttcgtgaaaagcaggctgatgttgaacaacgtccgtttacctttggtgactggctggtattgattgtcctgaccgccgtaatggtctgggtgatttggggcgtgatcgttaatgcctggtttattccagaaattgccagccagttcttcaccatgggtctggtgattggcatcatcggcgttgttttccgccttaacggcatgacggttaataccatggcttcatcctttaccgaaggggcgcgaatgatgatcgcccctgccctgctggtgggtttcgccaaagggattttgctgctggtcggtaatggtgaagcgggtgatgccagcgtgttaaataccatcctcaacagcattgccaatgccattagcggtctggacaacgcggtcgcggcctggtttatgttgctcttccaggcggtatttaatttcttcgtgacgtccggttctggtcaggcggcgttaaccatgccgttactggcaccgcttggcgatctggtcggtgttaaccgtcaggttaccgtgctggcgttccagtttggtgatggcttcagtcacatcatttacccaacctcagcgtcgttaatggcaacgctcggtgtgtgcagggtggacttccgtaactggctgaaggtgggcgcgaccctacttggactgctgtttattatgtccagcgtcgtagtgatcggcgctcagttgatgggctaccactaaaaatgttaagagccgcaattgcggctcttttttcattctgccgtttcagtctctacggcttcatttttggcattgcgcttcatccacaacgctagcgctttcagcgagtctggagtgaactcatcgcagcgtgcggtgatttcttccggcgtcagccagcaaacttcactgacttcatcttcctgtagtgcgaagggaccgtgagagacgcagctgaacaatgcgccccagacacggcaatttttatcttcgaaatagaactgcccgtgctcggcaaaggggacaccggcaatgcccaactcttcttccgcttcgcgacgcgcggattccagcagttgctcatcggcctggactacaccgcctgcggtcgcatctaacatgccgggtaaaaagtcttttgtctcggtacgacgctggaccagaattttgcccatgccatcatgcacgacgatgtaagttgcacgatgacgcagacactgtgcccgcatttgttcccggctggcttgtgcaatgacttcgttctcttcattgacaatatccacccattcagtacttgccaaacgacgctgttccattatcaggaaaccttctttttctggcgctcttacggcgcattttgagttgtgggtaaattacggattaatcgcgacctgcgcaatgatactttgatcattgagtgcgattacactaagtacgtcattatccagcatgccataactcgccggattaccgcctttcggaatactcaccgagccggggttgaagtggaaaatctccccccgctgttctgccactggcagatgggtatgaccgtacaccagcacatcgttctggtttaaagcaggcagattttccgggccaaaaagatgaccatgcgtcaaaaacagacgttgtttttccagtaatacctgttgccacggcgcggttatcgggaaatgcagcagcatttgatccacttcgctgtcgcagttgccgcgcacagcgataaccttatgtgccacttcattaagccgttcagcgactttggctggcgcgtaaccctccggtaaagcattacgcgggccgtgattcaacacgtcgccaaggatcaccagccactgggcaccgctttgggcaaacaactccagaacacgttccgtcgccggtaacgacccatgaatgtccgatgcaaacatcagtttcatcactcactcctcgtcgaaaaaacgtaagctatgatactggattctgtcgttgctatcagccagattgcttcgccgaaagtgcaataaaacgctggacagacgctcgctgccactggaatgttgcataatccaccaggcgttctggcacctcatcgccatgtagtaccaggcggttaatcattagcgccagatcagtatcagcaatgcaccattcaccaaataaattcggctgacccagtactaacaaatgttctgccatcgcgaacagtttctctgcactggcttttccctcggccgttagtggcgcttttttcgcccccgcaaagacaacatccgtcggacgctcttcgcggatgggcatcagatcgctgcgcagccaggcctgaatctgtcgtgcacgcgcacgattttctaaatcaagcggataaatacgttcccaggtcggtggcgcaaatcgatcttccagatactccgcaatggcagaagattcactcaactcaaaatcatcgatttgtaataacggcacacggcgtgtctgaccgtaaccttgccacgtcggctgcaaatgttcaccgctgtcgaggtcgatggtcttgatatgaaacgacaggcctttttcctgcaacgccacccaggcggataacacataaggggagaaaaagtgggcatctgaccaaagcgtgatagcgggtttactcattatgtcctcggcaataaagggggctggctatcaaactatagagcctttttgtcactgtcacgtgacgaatactcacgtaagtcgccgcgctttctatacttgtggtgttcagatgattaaacaaccggagctgcaatgatcgatctctatttcgccccgacacccaatggtcacaaaattacgctgtttctcgaagaagcagagctggattatcgcttgattaaggtagacctggggaaaggcggtcagtttcgtccggaatttttgcgcatttcgcccaacaacaaaattccggcaattgttgatcattctcctgccgatggcggcgaaccgctaagcctctttgagtctggtgccattttgttgtatctggctgagaaaacaggactctttttgagtcatgaaacgcgtgagcgcgccgccacattacagtggttattctggcaggtaggcggactggggccgatgcttgggcaaaatcatcattttaatcacgcagccccccaaaccattccttacgctattgaacgttatcaggttgaaactcagcgtctttaccatgtactgaacaagcggctggaaaactcgccctggctgggaggcgagaactacagcattgcggatattgcctgctggccgtgggttaatgcctggactcgccagcgaattgacctagcaatgtatccggcagtcaagaactggcatgagcggatccgttcgcgccctgccaccgggcaggcactgctaaaagcacaactcggtgatgagcgttcggatagttaacagaaacaggttctcgtgtattatttcatcctaagtaaaacaacggagaacctgcaatggcacaacctgccgctattattcgtataaagaaccttcgtttgcgtacgtttatcggaattaaggaagaagaaattaacaaccgtcaggatattgttatcaatgtgacgatccactaccccgccgataaagcgcgcactagcgaagatatcaacgatgcgctgaattatcgcaccgtaacgaaaaacattattcagcatgtagagaataaccgtttctctttgctggaaaaattaactcaggatgtgctcgatatcgcacgtgaacatcactgggtgacgtatgctgaagtggagatcgataaactgcacgcgctgcgctacgccgattcggtatccatgaccttaagctggcagcgttaatcgccatatcgggaggctgcatgaacatagtgatcaccggagggacaggattaattggtcgccatttgattccgcgtttgctggagctgggccatcaaattacggtagtgacgcgtaacccgcagaaagccagttccgttctcggccctcgggtgacactatggcaagggcttgccgatcaaagcaacctcaacggcgttgatgcggtaatcaacctggccggagaaccgattgctgataaacgctggactcacgagcaaaaagagcgtctctgccaaagccgctggaatatcacgcaaaaactggtcgatttgattaatgccagcgacacgccaccgtcggtactcatttccggctcggcaacgggctattatggtgacttaggtgaagtggtggttaccgaagaggaaccgccgcataacgaatttacccataaactctgcgctcgctgggaagaaattgcctgccgggcgcaaagtgacaaaacgcgagtgtgcctgctgcgtaccggtgtagtgctggcaccggatggcggtattctcggtaaaatgctgccgccgtttcgtcttggcctgggcgggccgattggctctggtcggcagtatctggcctggattcatattgatgatatggtcaacggtattctctggctgctggataacgagctgcgcgggccatttaatatggtttcgccctacccggtacgcaatgaacaatttgcccatgcgctcggtcatgcgctgcatcgcccggccattttgcgcgtccccgcgaccgccattcgactgttaatgggcgaatcttcagtactggtattaggtggacaacgcgcgctgcctaaacggctggaagaagcgggttttgcgtttcgctggtacgatttagaagaggcgctggcggatgtcgttcgctgatgtggtttacagcaaacatccgccagttaactcccggtgttacaggattagtggctttgcgcgataagatcgtctggtgaaagtcgggtcaccatcataactaactctctgtctaaacctctatccagcatctcctgagcaatacgcagggcttcttcgtgtttgccctgcattgcgccttcttcacgtaatctgtcagcaatggtcatcagtttctccttttcttgtggtgcgcgttccgctatctcaccaataaatgcacgaaaacgctgggcatcccctgtttgtaatacgtaattaaacagggcttttagctgtctgtcattagtgttccctgtaactagcagcgaaacaatttggtcgactaatcccaacagatcgcgctgacgaatatgtttctgaattaactccaacagcgccattttgcggtgttgcataatctcgtcatccggcaccacggtaatatccaccaacggaaaagccgatgaatatattttgcgggctatagcaggctcggcaaattcatcaagccagcagagtgaataaggataaggacttctgcaaccatgataaaacagcatcgggagcaccaatggaagctctttatagcccgcatcaagatggttttgcattgccgcaatggaataacgcatcatgcgaaaagccattaattcttccggcttactttggtgctctatcactacataaatataacccactccctcctgcgttttcacagaccacaagaggtcggaataatattgccgcaggtcttcatcaataaaactgtttggttccagtttaagcgtcgttaaatcacacagtttgcgcagcggcgcgggaagatgaatatcaataaaatcccgcgcggtgtctggatggcgtaaaaaagatttaaataccgcatcatgcggcgtggaagttgtcgatattgtcatggcgttccgtcacccctcaaatttaagatgacgcgacaataaccacgattaacacccaatgcagcaggcagtttttatctttggacagcgaattcagaagtatttttagcggactgtaacttttacatttcagcggaagctgactcgcaaattccccatgaaaatactccggcagcgttagccaccggagaggaaattatttcagcgatcccttaaggaaccgttgcagacgagggctttgcgggttgccaaataactgctccggcgcgccctcttcttctattttcccctgatggaggaaaatgacatgagtagaaacatggcgagcaaagcccatttcgtgagtcactaccaccatggttttcccctcttctgccagttgctgcataatacgcaacacttcgcctaccagttcaggatcgagcgccgaggtaggttcatcaaacagtaaaacttccggttccatcgccagcgcccgcgcgatagaaacacgctgttgctgaccgccggaaagatgcaccggatatttcccctgcgcacgttcgtctatcccgacttttgccagatacttcaccgcccgctcgcgcgcttcctgcttgctcaggcccaacacctgaatcggcgcttccatgacgttttccagcaccgtcatatggctccagagattgaagtgctggaataccatcgtcaggcgtgtgcgcagtaagcgcagttgatttttatcggcgactttgagttgaccgtctttgtcgcgcaccagattgatcgtctggccattgaccacgatcgacccttcactcggtttttcgaggaagttaatgcagcgcagaaaggtacttttccccgatcccgacgatccgatgatgcttattacatctccggcattcgcttgcagtgatacccctttcagcacttcatgttcgccgtagcgtttgtgcaaatcgataacgtttaatttattctcggacatcgtattctcagtgcgttgaagaaggtttcacatgctgcaaccagcgtttttccgctctgcgaaagaggctgatcaggacataagagatgattaaatagagcaccgcggcaatgccgaaggcggtaaaaggttgatacgtggcggcgttaatatcgcgggctattttcagcagatccggcaccgtggcagtaaatgccaacgcagtagagtgcagcatcaggatcacttcgttgctgtatgccggtaacgcaatacgcagcgcagaaggcaaaataatgcagcgatacattttaaaagtcgagaagccataggctctggcggcttcaatttccccatgcggaaccgaacggattgccccagcaaaaatctcggtagtgtaagcgcaggtgttaagcgtcagcgccagcacggtacagttcaggccactgcggaagaaagcgttaaggaattcggttcccttaacaatctcaagcgtgtacatgccggaatagaacaccagcaactgaacatacagcggcgtaccgcgaaaaatataggtaaataaccagattggaaactggatgtatttattactggagacacgaccaatcgccagaaacagcgccaggactccgcctatcactaccgacaaaataagcagccacagagtgatcgccacaccagtaaagcgataaccgtcggtccacagcagcggtttccagtattcatgtaagatttcgatcacaggtcagccctcttcacacccacggagtagcggcgctcaaggaacagcagcacaccattggaaacagtggtgaaaaccaggtaaatcacgccacagacgatggcgaaatagaacggttcccaggtacttttgcctgccagttgggtggctttgaccacatcttccaggccgagtaacgaaaccagtgcggtagatttgaggatcacctgccagttgttgccaatgcctggcagggcgtaacgcatcatcgacggaaacatgatccgccgaaacacttgcccacgagtaaaaccgaacgccgtcgccgcctctatatgtcctttcggcactgccataaaagcaccacggaacgtttcggtaaaataagcaccgtagataaaaccgagagtgataataccagcgaccatcggatcgatatcaatctgcccgacgcccatcgcctccgtcaccgtgtttagcgcaatctgcaaaccgtagaaaatcagcagcatcaacactaagtccggcacgccacgaatcagcgtggtgtacccttcgaaaatcagccccgaaagccgattttgcgagagcttaccgccagcgccaattaaaccgatgattacagcgagcactacagagctgatagccagctccagcgtgacgagcgcaccctgtaaaataacacctgaaaacccatacaacatgctgcctgtcctgtcgtgtgtggtgaattaccgcctcttgtctccctccggttacccgaagggagcgggctttctttcaccgatggcgattagccaccataaacatcaaaatcgaagtactttttcgctaatttctcgtaagtaccgtcagcgcgcatttcggcaaaggctttgttcagtgcttcgcgcagttcgttatcttctttacgcaggcccatgccggtccctacgccaaacagtttttcatctttaacagacgggccaccgaatttgtaatctttaccgacaggttgtttgaggaaaccttcgctggcagcgacctcatcctggaacgcggcatcaatacgtccggcagtcaggtcagaataaatgttgtcctgcccctgatacgagacgatttcaatgccttttggtgcccaatgttcattaccgaacgtctcctgggtggtgccctgcaatacgcctacccgtttgcctttcagcgactcgactgtcggctgaatgtcagaatttttcgccaccaccaaacgagaatcggcagcgtacagtttgtcggtgaaggctatttcttgctgacgtttttccgtaatggaaagcgatgacatgatggcgtcaatcttcttcgcttttaaggacgggattaacgcatccagcggattttcgacaaacgtacattgcgtattgatgcgtttgcataattcctttgccagatcgatatcgaagccaaccagttcgccttgtgaattttttgattcaaatggcgcataggtcgggtcggtaccgatgcggatgttttgcggaatcgcagcaaacgccgcagttgcgctggagaaggccagaaccagagagagcgatagcaccagttttttcataatgtcctcaactgacagtctttttatagggaatatttacaggtttgttacacttatcgtgccataaaattgaccatcaaggcaaaatatcccgccccgttagacgtattatttttcattaaaaatgcttaagtatgcatttcaatgcaccacgatagtgcaacaaacctggcgtgcaccatgatgatcattccatcaggtacagcttcccagcgacgtatcagtcaccgtagacattaaagtcgaaatactttttcgccatcttgtcgtaggtgccgtcctgacgcagctcgccaagcgccttattgaaggcagccgtcagttcagcatcatctttacgtagccctacaccggtgccatcaccgaagtattttttgtcttttactgatgagccagcaaaggcgaaatctttaccagcaggttgcttgaggaatccttcgctggcagcaacttcatcttgtaacgcagcatccagacgtcctgcagccagatcggaatagaccaaatcctggttggcataggccaccacatccacgcctttactacgccaggtctcgttagcgtaagcttcctgggttgatccctgcagcacaccaacatgtttacctttcagtgaatccagcgttggctgaatcggtgaacctttggccgcaatcaaacgagaatctgcggcgtacagcttgtcggagaaggcaatctcctgctgacgtttatcggtaatggaaagcgacgaaataatagcgtcgatttttttcgctttcagtgaggggatcagcgcgtcaaagtcactggcaacccaggtacatttcacctgcatccgtttgcacatctcgttaccgagatcgatatcaaagccaacaaaatcacctttagcatctttcgatgagaacggtgcgtaggtggtatcggttccgatacgtaccgtctccggtagcgccgcatagctggaagccgctgtggagagaccgactaacaaagacagagcgagaatcgacttcttcatacataaccctcaagtgaaaatggcttttttatgttgtgtattgtgttgtgtgtttgcaggctctttcatgcaggtcttatgccatcttgacgacaacagtaacattcaacgttaaatatgttaataagacgttgcattattgtcctgaagttgaagatagcaggtatagcggttgaatcgcagcgtttcgattgaatggcagaaacaaaatgtcgaggatttgatcgcggttgcaaaattgccctgaaacagggcaacagcggagttatgcgccctgccagcgggcaaagagatcttcaggaagggttatcgcaaactggtcaagaacacgattaaccgtctgatttatcacatcatcaagggattgcgggcgatgataaaacgccggaacgggaggcataatcaccgcaccgatttctgccgcctgagtcattaaacgcagatggcctaagtgcaatggtgtttcacgcacgcagagcaccaacgggcgacgctctttcagcaccacatctgccgcacgggtcagtaagccatcagtatagctatggacaatgccggaaagggttttgattgaacagggtaaaatcaccatccccagcgtctggaaagaaccggaagagatgctggcggcaatatcgcgcgcatcgtgcgtgacatcggctaatgcctgcacttcgcgcagagaaaaatccgtttcgagggataaggtctggcgcgctgcctggctcatcaccagatgcgtttcgatatctgtgacatcgcgcagaacctgtaataagcgcacgccataaatcgcgccgctggcaccgctgatgcctacaatgagtcgtttcataaatagttgccctgtcagacttgcaggcagactttgcaggatttcggcgggagttgcaagtcagggtgccagaccggcaccctcagcgaaggcatcatccttcgttatgcatttcgagattttccacttcgttctgacgttgcactgctttggcgtcatcattacgtaacgtatcgaggaaatcgaggtagccctgatcaacatctttggtgacgtagacgccgttgaacaccgagcattcaaactgctggatatccggattttcagcgcgaacggcgtcgatcagatcgttcagatcctggaaaatcaacccgtcagcaccgatgatctggcgaatttcatcaacttcgcgaccgtgagcgatcagttccgtggcgctcggcatatcaataccataaacgttcgggaagcgaatttccggtgccgcagaagcgaggtacactttcttcgctccggcttcgcgtgccatctcgataatctgctcagaagtggtgccacggacgatggagtcgtcgaccagcaggacgtttttatcgcggaactcggcgcggttggcattcagtttacggcgcacggacttacgacgcagctgctggcccggcatgataaaggtgcggccaacatagcggtttttaacgaagccctggcggtacggtttgcccagaatacgagcaatttccagcgcgatatcacacgaggtttctgggatcgggatcaccacgtcgatatccagatcttcccattcgcgggcaattttctcgcccagtttcgtgcccatattcacacgcgcgctgtaaacggaaattttgtcgataaacgagtccgggcgggcaaagtatacatactcaaacaggcacggattgctgaccggattgtcagcacattgacgggtaaacaactgcccttcttcagtgatgtaaatcgcttcgcccggcgcgacgtcacgcaggaaatcaaagcccagcgtatcgagcgctacgctttcggaagcgaccatatattctgtacggttctcgtcaatatcacgttttcccagtaccagcggacgaatcccgtttggatcgcggaaagcaaccataccgtggccgataatcatcgccacacaggcatacgcgccgcggattaagcggtttgtggcagcaatggcagcgaaaatattgtcggcttccagcgggtagtggcggaagttgtccagctcgctggcgaagatattaagcagaatttccgagtcggaagtggtgttgatgtggcggcgtttttcttcaaacagttttttacgcaactcgtgagcgttggtcagattgccgttgtgggcaagcgtaatgccatacggggagttaacgtaaaacggctgcgcttcagaggcgctggagctgccagccgtggggtaacgcacatgaccaatgcccatattgccctgcaaacgctgcatatggcgagcttcaaatacatcgctcaccagcccgttcgctttacgcaaacggaagcagttattggcatctatggtgatgatgccggcggcatcctgaccgcgatgctgaagcaccgttaaggcatcataaatcgactggttaaccggcataacaccggcgataccgacaataccgcacatacgtctttttcctcgttaagccacatctcagagcacttacgctctgggcaagaaacttgacgagctttgcagataatcaaaaaaacatctgatgataaaactgaattgcgggatcagctgtgatttgctccagtcttcgcttttcgacaccccggtaaaggagtcgagaaagaagagaatggcagcaacaatcaacacaccgcgcaacgcaccgaaacagacgcccagcacccgatcggtgcctgacaaccccgttttctccaccaactggcctatcacgaagttcacgatagcaccaacgatcagggtagcgataaacagtaccgcgatggcaatcccatttcgaaccagttcgtcttcaaagcccgtaaaccagactgacaggtaagtgtagtaatgactggcaacaaagaaagcacaaccccatgtcaccagcgataacgcttcacgaacaaagccgcggatcaggctaaccagagaggaaaaagcaatcaccgcgattatggcgtaatcaatccagaccatatgtgtcccacgattttacgccctgtcatcctgttcggggcgcattctaacagaaaaagaaaacgtttgcgtagggatttccttcccgcgcatcaataaaaatggcgctgaaaaaatattcaacgccatcgactttttatgcctttgcggcatcgggcaatgcgtgtcggatgcggcgtaaacgccttatccgacctacggttctacccctgcgtaggcctgataagacgcgccagcgtcgcatcaggcaagaccgtattaattcggcgtatagcccattaccacgccacttaagccagaaagttgcttcaactcacccagcgaacctttcagcttatctttcgaggcatccggcccaaccagaatacgggtaattttaccctgcactggcgtggatggcgacgtataaacccgataaccggcaccgcgcagcttaccgacaatctcattcactttatcggcatttttcagcgcacccagttgcacaacataggctttacccgtcggtgcagctttttcttccacgaccggcttcggttctggcttcggcgcaggtggtgcttcaacctttggtttaggcggctccaccggtttcggcttcggtggggcgaccggtgcaggttccggttcaaactcggtgttattggctgcaatagtggccggatcgagcgacggtgctgcggcatcacctgcccgcacctcttccgctgcgccttccggcggctgcgtcggtaacgcctgggtggcggctggcatcatatcaggctcatcacgatcgcccgctttcggcaccagcgggatagccgcgaactcatcctgataatgttttttctgcccgtccagcagccctggaagtacaatcacccccagcgccaccagcacgatcgtgcccactaaccgattctgaaacttacttgccaccgcttctcctcgcgtcaatcacttccatgacatgtgcgaccgtgtggaaagaaccacacaccagcacggtgtcttccgctttagcgtccgccattgcggcatcccatgcctgcgcaacgctatcaaatgatttgccgttacccaaatgctcaagcagttgttctgccgtggcaccgcgcggcccttccagtggcgcacaataccagtcatcaaccacgcttttcaaccaggccagagttccggcaatatctttatcatgtagcataccgataaccgccagcacgcgcccgtttttcggtagcgctttcatacgcccggtgagatattccgccgcatgtggattatgcgcgacatcaaaaataacgcgtggcgactcgctcacaatctggaaacgtcccggcaaaattgcgctggcaatcccgtcgcgaatggcattttcactgacttccagcccgctggcacgcagtgccgccagcgctgttgcggcattcggttgcgggacaagcggcaacggcagattttccagcgtgccgtgagcatcgctaaacgcccagtcatgatcggtgacggaatagttccactcaacgccccgacgttgtaacagtgcacctttttcctgcgccacatcagcaatggtagaaggcatttccggctcaccgacaattgccggtttttcgctgcggaagatgcctgctttctcgcgaccaatactttcgcgatctggacccagccagtcggtatgatccagcgcaatactggttactaccgcgacatcggcgtcgacaatattggttgcgtccagacgaccgcccagccctacttccagaatcaccacgtcaagttgtgcctgcttgaacagccacaacgccgacagcgtaccgtactcgaaataggtcagggaaatatcaccgcgtgccgattcaatctccgcaaaagaggcggtgtgggccgattccggcaattcctggccctgcacacgtacgcgctcggtataacgcaccagatgaggcgaactgtagacgcccactttgtaccctgccgccatcagaatcgactccagcgtacggcaggtggtgcctttgccattcgtacccgcaacggtaaacacaaatggcgctggtttcaggacgccaagacgcgccgcgaccaggctcacgcgctcaaggccgagatcgatagttttactgtgcaggttttccagataagaaagccacgaagccagaggcgacgcggcttgaggagtgcgtttgataatcatggtatccgctgattcgttacggtgagaatagcaaaagggcagagccagtggccctgcccttatcagttatcaggcctcaggttcctgatccggtaccgggggtaccactacgccttcacgcggcgcttcaggattcggcgctggcagattcatcaacttcgccagaatgctcgccagtttcaggcgcatttccggacgacggacgatcatgtcgatcgcgcctttctcgatcaggaattcactgcgctggaatccaggcggcagtttttcgcgaacggtctgttcgataacacgcggaccggcaaagccgattaacgctttcggttcagcgatgttgagatcgcccagcatggcgaaacttgcagaaacaccgcccatcgtcgggtcggtcagcacggagatgtacggcaagccgcgctcctgcatttttgccagtgccgcagaggttttcgccatctgcatcagcgacatcagtgcttcctgcatacgtgcgccaccagaggcggagaagcagatcagcgggcagttatcttccagcgcctgctcaacggcacgcacgaaacgtgcacccacaacagaccccattgaaccgcccataaaggcgaactcgaatgccgcagcgacaaccggcattccatacagagtgcctttcatcaccaccagcgcatctttttcgccggtttctttctgcgcagatgccagacggtctttatacttcttggagtcacgaaacttcagcacatctttcggctcaagctcgctacccagctccacaaggcttccttcatctaacaggctatgcaggcgattacgcgctgtcatacgcatgtgatggtcacacttcggacagacctcaagattacgttccagctcagcgcggtataaaacctgaccgcagctatcacacttagtccacaccccttcaggaatgctcgccttgcgggtgggagtaatgttgcttttaattcgttcaatccagctcattagggacctttctgtctgaacctggttcgatgccagttttatctttggggacgcataatgccatttttgcccccaacagaccatgaatgttgcacattaaaacataacagcccgaaactttggataaaaaagtggtcgaaccgcggagttactttttattttgcggcgcgtgccgcagcgcgtttgtgacggattatttcgatgacgcccggcaaaatagaaaccacaataatcccgacgatcagcagcttaaggttatcctgaaccatcgggattgtaccgaagaaatagcctgcgtaggtaaaaagcagtacccacaacagtgcgccgatcacgttataagcggcgaaatgacggtacgacatgtggcccattcccgcaacaaacggggcgaacgttctgacgatcggcacaaaacgggcgagaataatcgttttgccgccatgtttctcataaaactgatgggttttgtcgagataactgcgacggaaaattttcgaattgggattactgaacaacttttcaccgaacaaccgcccgatagtgtaattgaccgcgtcacccacaatcgcggcgatcagcatcagcaccaccatcatatggacgttgagatcgttggtttccagtgatgccaacgctccggcaacaaacagcaatgaatcacccggtaaaaacggcgttaccaccagaccggtttcacagaacaaaattaagaacaaaatggcataaacccagacgccgtactccgcgaccagctctgccagatgcacgtcaatgtgcaggataaaatcgatgaggaaataaatcaggtccatatttgcctatgccttgtactcgtcatctttcaggctgtaactacgttggctacagcctgaaatgttccgagcattattctcgttagtccgccagaaatagcgggcccattggcggttttggaagatcataccggtcagggtaatccaccgcgaccagatacagcccttccgcttttgccgttgctgccgccagcgttctgtcctttgccgccagcaactctgctatccagctctccggctggttgtgggcaccgacttccatcaggctgccgacaatattcctgaccatatgatgtacaaaagcattcgctttaatatctaccaccacataaggaccgtgacgcgtgacattaatatgcataacgttgcgccacggggttcgggactggcactgcaccgcacggaacgaggtgaaatcattctcgcccagcaagcattgcgcagcccgatgcatccgttcagcgtccagcggttcgtaaaaatgggttacccctttactcagtaccgccgggcgcagccgatgattgtagatgatgtagcgataacggcgagccgtggcgctaaatcgggcatgaaaatcatcaggtacagttttaacccaacgcacagcgatgtcaccaggtaaattcgcatttacgcccaaggtccacgccgcgtctttgcgcagcgcggttgtttcgaaatgcacaacctgcccggtaccgtgtacccctgcgtcagtacgcccggcgcagaagacggtgatgggttcgttcgccacctgggagagcgccttttccagcttctcctgcacactgcggacttcgttctgccgttgccagccgtaatacttactgccgtcgtactcaatgcccagcgcaattttataaactggcggttgttgctggtcggacattagtacagatactcctgcaccagtttctcggcgatttttactgccatcagcgcgccgccaaagcgaacgttatcggccaccgaccagaactggacttgctccggcataccgtagtcattacgcacgcagccaacagaaagatgcggcgtacccgaagcatcacctacctgagttgggaattcgttctcttcagagagcacaatatcttcgccttgaacaaacgcatcacgcgcttcttctgctgccagtggacgcagagcttcaaagttgaccatctgggcatgaccgtagaataccggtgcctggacgacgctagccgaaatcatcagcccttcgtcctgcaggattttgcgtacttcgtcaacgatacgacgttcttcacgcacgctaccttcgctatccggcagtaacggcagcatgttgaacgccagctgacgcccgaagaaatcttcttcgtcaatcggaatgccgttgagcaatttcgcactctgccccgctaacgcatcgaccgcttttttgccctgggcggaggctgaaatcaggctggtaacgctgatacgtgataaaccgccctgatcgattaacggtttcagtgccgccagcagctggctggtcagactgtctggtacggcgatgacattccggttccggtaatctgtcagtacaaacgggtttacttccggcaccaccagcggtacgtcgggttcgagagcaaacaatccactgctgtcgatcaccaggcaacctgagttggtcgcttcttcaacccaggcagcggtagcttctttgcctgcgacaaaaaatgccagctgcgcctgcgtccagtcgaattcagcggcatcctgcacggtgattgtcttaccaccaaagcgcagttgttcgcctgcgctttcgttacgtgccagtgcataaatttccccaaccgggaactgacgttcagccagcgtttcaagcagggcttcgcccacagcgccagttgcgcccaggacggcaatgttccagccttcagacatggtggtttactccagaaatagcaaagctccctgccaatgttacagcagagagcatgaagaagagattaacgtgccggatgatgaacggcgttaaaacccagtttacacagcaatgatgccgcactggcgtcatcacaaattacatacagagatgaccattcacggcgctcaagatagtttttgcgcagtttatcgaactcacccggtatcccggcgactttacgcagcggtgcgtcatcgcggcgcacatcatacaccaaatgcaccagccttttcagcgtcggttgatcgagcgggccatgcagcgtaatgcgaccaaactctggcgcaggcagtaatgtatccagcgcaacgtgctgttcatgcccaataaacttgctataagcttcaaacacttgcgtagtaccgcgtgctttaccttccagggtatagcctgcgatatgcgacgtgccgatatccacttttttcagcagctcgacgttgagttccggttcgccttcccagacatccagcactacgcttaacttctggccttcattcaggcaggtcagcaacgcagtattatcgacgactgcgccacggcaggcgttaatcagaatcgctccgggcttcaggctacggatcagtttttcatccgccagatgtagcgttttgtacggaccatctttaaagagtggcgtatggaaagtcagaatatccgcgcgctggactaactcatccagcgagcggaaatcaccctcatccccacggtcggcgcgaggcggatcgcaaagtaaggttttaatccctaacgcttccagtcgcgcctgcaatcgacgtccaacgttaccaacgcccacgatccccaccgtacggtcgtacagtgaaaatccatcgcgttcggcaagcatcagcagggaggagaaaacatattccaccaccgcaatcgcattacagccaggtgcagcggaaaaaccaattcccgcctgcttcaaccatgcttcatcgacatggtcggtccccgcagtggcagtgccaacaaatttaatgggttttcctgccagcaaagattcattcactttcgtgaccgaacgcaccatcagcgcatccgcgtctgccagttgagcgacggggattggacgcccgggaaccgcggtcacctcacccaaacggctaaataagtcgcgggcataaggcatattttcatcaacaaggattttcacgtttgtgttacctgtatgagacgagagttaaccggacaagtgtgccataatctcgcggccaggcatacttgcgaagatttcaggtataaggatacgtaatgatacaacctatttccggccctcctcctgggcaaccaccaggtcagggagataatctgccgtctggcacgggcaatcagcctttatccagtcagcaacgtacttcgctggaaagcttaatgacgaaagtgacctcactgacgcaacagcaaagagcagaactgtgggcgggtatcaggcacgatattggtctgtcgggagattcaccgctgctttcgcgtcacttccctgccgctgagcataatctggcgcaacgtctgctggccgcgcaaaaaagccattctgcccgccagcttttagcgcaattaggggagtatttacgtctggggaataatcgtcaggcggtcacggattatatccgtcataactttggtcagacgccgctgaatcagctctcaccggagcaattaaaaaccattctcaccctgttgcaggaagggaagatggttattccgcaaccacagcagcgcgaggcgaccgaccgtcctttattaccggcggagcacaatgcgctaaaacagctggtgaccaaacttgcggcggcaacgggggaacccagcaaacagatctggcaatcgatgctggaactttccggggtgaaagatggcgagttaattccagcgaaactgtttaaccatctggtgacctggctacaggcgcgtcagacgctaagccagcaaaatacgccgacgctggaatcactacagatgacgctaaaacaacctttagatgccagtgaactggcggcgttatcggcatatatccagcaaaaatatggtctttctgcgcaatcatcgctttcttctgcccaggccgaggatattcttaatcagctttatcaacggcgggttaaagggattgatccgcgtgttatgcaaccgctgcttaatccttttccaccgatgatggacacgttgcaaaatatggcaacgcgtcccgcgctgtggatactgttagtcgcgattatcctgatgctggtctggctggttcgttaaccccgacgaaatgacagtatcgtgacaataatacccagcaccgcagagatcgccccggcaagaaataccgaagagtaaccaaacgtggtcgccagcattcccgccagcggcccggagacgccgagggcgatatcctgaaacgcggcgtaaccgcccagtgcggtgccgcgaacttgtgaggggacgcgtttaaccacctccacgcccagcgcaggaaagataagcgaacatccggctccggttaacgccgcgcccgctaatgcgacccatgcacctggggcttgccagagcagcaacaagcccaccgtttctacaagcagagagacaatcgccactttcacgccgccaaaacggtccggcatccagccaaacatgacgcgcatcacgacaaatgcgccgccaaacgcggtaagagtaaagcccgccatcgcccatcctttgctggcaaagtagagcgaaacgaaagtcccgataacagcaaaaccaacgccttgtagtgccagacctaaccctggtttccagataagcccgacaacgctccacagcgatggacgttctcccgccagggccggtactttgcgcactgtgccgttacaggcccacgccagtacgggtaataccattgtggtgatcgccagtgcggcaaaaccgtaatggctatgaatcaacaggccaagcggagcaccaacagcgagggcaccgtaaatcgccattccgttccatgacatcactttgccagagtgttttggccctacgatgcctagtccccaggtcagagcgcctgtcagtaactggctttcaccaaagccaagaatcaaacgcccgacgaccaacagagcaaatttgaacggtgcggagacaggcaaaatcgccgccagcagcaacgcgccgccagccagaccacaagctaacattccctgaagcgccgaacgttttgcaccatattgatcggccagtcgcccggcgtaaccacgcgtcagcaccgtagccagaaactgaatcccgacggcaatgccgaccatggtattgccatagcccagttcatgatgaacaaacagcgggataaccggcaacggcaaccctacggtcatgtaggtgagaaaaaccgcaaaagcgatgcggaagagcgaaaaattggcagaagatcgtgtttcggtttggcttacagcagtcatgcattactccagaatgcagcgcaaggcgaggagtatccccgtctcatctctctggtttcagggttacggtgcgttggcaggatttaacgcgtacgtcttttcagaaggaaatcgacaaagcgggaagtttgcctggaactggcggcgattgtcaatgatgtgaaaaagggaaccatcaggttcccttttgcgttagtgccggaggccgcattggcgcgtaacgtcggatgcgacgctggcgcgtctactccgacctactgcgaattaatctttcagcttgcgcattaccagcgtggcgttggtgccgccgaagccgaagctgttagacataacggtggtcagttcgcgatcggtcgtttcggtcacgatgttcagacccgcagcctgctcgtccagctcttcaatgttgatgctcggggcgataaagccgtgttccagcatcagcagagagtagatagcttcctgtacgccagcagcgcccagagagtgaccggtcatggctttggttgcagaaatcgccgggctcttatcgccgaacacttcacggatagctgccagctctttcacgtcgccaaccggagtcgaagtaccgtgggagttcaggtaatcgattggggtatcaacgccatgcatcgccatcttcatgcagcgtactgcgccttcgccagacggagcaaccatgtctgcaccatcagaggttgcgccgtagccaacgatttcagcatagatgtgagcaccacgcgccagcgcgtgttccagctcttcaaccactaccataccgccgccgccagcgataacgaaaccgtcacggtgagcgtcgtaagtacgggaggctttttccggggtgtcgttgtatttagtagacagcgcacccattgcgtcgaattcgcaagccatttcccagcacagctcttcgccgccgccagcaaacacgatgtcctgtttgcccagttggatctgctctactgcgttaccgatacagtgtgcggaagtcgcacacgcggagctgatggagtagttaacgccatgaattttaaacggggtggcgaggcaggcagaaacgccggatgccatcgctttggtgaccacatacgggccaaccgctttcaggccgcgcgggccgcgcattgcgtcagcgccgaacacctggaaacgcggggagccgccgccggaacctgcaatcaggccaacgcgcgggttattctggtaagcttccggagagaggcccgcatcagcgattgcctgctccatagaaaggaatgcataaatggatgcgtcgctcataaagcgcacaactttgcggtcaatgaggccagtggtatccagttttacgttgccccagacgtggctacgcatgccggaatccttcagctcctgagagaaagtgatccctgaacgtccttcacgcagagatgccaggacttcctgctggttattaccgatgctggaaacaatgcccaggccagtaatcactgcacgtttcattcaatacctctgtaagtcgcacatagagtaagtttcgaatgcacaatagcgtacacttgtacgccgaacaagtccgatcagccatttaatagagaaatttgcgcagccttacacacatcgctaagatcgagccaccgcctgtaagacgagtaacttacgtgaaacactactccatacaacctgccaacctcgaatttaatgctgagggtacacctgtttcccgagattttgacgatgtctatttttccaacgataacgggctggaagagacgcgttatgtttttctgggaggcaaccaattagaggtacgctttcctgagcatccacatcctctgtttgtggtagcagagagcggcttcggcaccggattaaacttcctgacgctatggcaggcatttgatcagtttcgcgaagcgcatccgcaagcgcaattacaacgcttacatttcattagttttgagaaatttcccctcacccgtgcggatttagccttagcgcatcaacactggccggaactggctccgtgggcagaacaacttcaggcgcagtggccaatgcccttgcccggttgccatcgtttattgctcgatgaaggccgcgtgacgctggatttatggtttggcgatattaacgaactgaccagccaactggacgattcgctaaatcaaaaagtagatgcctggtttctggacggctttgcgccagcgaaaaacccggatatgtggacgcaaaatctgtttaacgccatggcaaggttggcgcgtccgggcggcacgctggcgacatttacgtctgccggttttgtccgccgcggtttgcaggacgccggattcacgatgcaaaaacgtaagggctttgggcgcaaacgggaaatgctttgcggggtgatggaacagacattaccgctcccctgctccgcgccgtggtttaaccgcacgggcagcagcaaacgggaagcggcgattatcggcggtggtattgccagcgcgttgttgtcgctggcgctattacggcgcggctggcaggtaacgctttattgcgcggatgaggcccccgcactgggtgcttccggcaatcgccagggggcgctgtatccgttattaagcaaacacgatgaggcgctaaaccgctttttctctaatgcgtttacttttgctcgtcggttttacgaccaattacccgttaaatttgatcatgactggtgcggcgtcacgcagttaggctgggatgagaaaagccagcataaaatcgcacagatgttgtcaatggatttacccgcagaactggctgtagccgttgaggcaaatgcggttgaacaaattacgggcgttgcgacaaattgcagcggcattacttatccgcaaggtggttggctgtgcccagcagaactgacccgtaatgtgctggaactggcgcaacagcagggtttgcagatttattatcaatatcagttacagaatttatcccgtaaggatgactgttggttgttgaattttgcaggagatcagcaagcaacacacagcgtagtggtactggcgaacgggcatcaaatcagccgattcagccaaacgtcgactctcccggtgtattcggttgccgggcaggtcagccatattccgacaacgccggaattggcagagctgaagcaggtgctgtgctatgacggttatctcacgccacaaaatccggcgaatcaacatcattgtattggtgccagttatcatcgcggcagcgaagatacggcgtacagtgaggacgatcagcagcagaatcgccagcggttgattgattgtttcccgcaggcacagtgggcaaaagaggttgatgtcagtgataaagaggcgcgctgcggtgtgcgttgtgccacccgcgatcatctgccaatggtaggcaatgttcccgattatgaggcaacactcgtggaatatgcgtcgttggcggagcagaaagatgaggcggtaagcgcgccggtttttgacgatctctttatgtttgcggctttaggttctcgcggtttgtgttctgccccgctgtgtgccgagattctggcggcgcagatgagcgacgaaccgattccgatggatgccagtacgctggcggcgttaaacccgaatcggttatgggtgcggaaattgttgaagggtaaagcggttaaggcggggtaatctgctctcgcagtgtttgccggatgcggcgtgaacgccttatccgacctacgtgtgacgtgtaggcctgataagacgcgataagcgtcgcatcaggcatgctgctccagacgccgcaacttactgctgtgacgcctgctgaaacaggttttcccacatatcggtcaccagcgcctggtcacgcggcgacaattcaccagcaccaatggctttttccagactctggctaacggtcgtatgcaccgcctgagcggagtggtcatcaccactttccagttctgcgatggctaatgtcaggtggccacgcaaatacccactggcaaacaactcatcatcactggcatggtcaaccataccgtcgattaatgccagaatgcgtgattcaaactccgcgatcatcttctttcctcattgtaaaacgtggcgctggcttcagttgagcgcttccggccacgggaactgttccgccgtaagttccggcgtgtgataataattttgtagtgctttaatgaagcgtgccggacgttccggaatgccatttgtcagataatccatcacctgcgcatgtactcgccgttgaaacaccacacgatccggttcgaaatccccttccagattgtcgcaactgacgttaaacggatatcccgccgccacacagaacaaccagtcgagcgcctgcggcttcacttcaacatcttcaaactggctttgcgtttgggcatcgcgtccgtccgggcaataccagtagccgaaatcaaccagctcacggcgcgctttcccggcaatacaccagtgcgaaatctcatgaattgcgctggcataaaagccatgagcaaagacgattcggttatacggtacttccgcatcagcaggaagatagatcggttcgtcgtcgcctttaatcagacgggtattaaaatcatcggcaaagcagctattaaaaatttcaatcaactgctcgtagtggtgtgtactgttcattagttcatccccaaccagtggaggatctcctgtccgtggctgtcgtaaagtaatttggcactcatcaccgccgagacgataacaatcatcgggcggatcagcttttgtcctttgctcaacaccagtcgtgaacccatgcgcgcgccgaggaactgccccaccagcatgacaaagcccgtcgcccaaatcactttgccgccgagaataaacagcagtaaaccgccgatgtttgacgttgcgttgagtaatttggcgtgagccgtggctttggcgaggttaaatccgcacagcgtaacgaaggccagcgcgtaaaacgacccggcagccgggccaaagaatccatcataaaaaccgacgcagccaccggctattaacgcgaagggtaaaccgtacatccggcgctggcggtcttcttcacctagctttggcatcagcaagaaatagaggccgatacaaattaccagaatgggcaaaatctgccgtaagacatcagcctgaacgtattgcaccagcagtgcgccgctcattgagccgacaaaggtcatggcgatattgagtttctgatcgcttaaactaaccactttgcggcgaataaagtagatagtagcggaaatagagccgccgcaggcttgcagtttattggttgccagcgcattagcgggagacatccccgctgccatcaatgccggaatggtgagtaacccaccgccaccggcaatcgagtcgataaatcccgccagcatggcgacaaaaaagagaactcccagcaacagcggggaaaccataaacaggctattaaacgtttccattagatcacgtgctcatccagtagcgcctggcaggaaggcggcaacggaggcggtgtcttcttctcaggctttgttgttcccggttttggaggttcaaaccagctttgcagttctgccccgcaaccatcgcctgatggcggtaaaggttgatcttcacactccagactatcggcagggcaacgtaatcgtacatgcatatgcgcgcgatgctggaaccagggtcgcactttgcgcaaccagtcgcgatcggtgcccgcatcaaggcaaagttgttgtttaatcgccggattaacaaaaatgcgcgtgacgtctttgtcctgggcggcgagtttgatcaagctgaaaatttctggcttccacagcgtggagacaacgtgtttaccgtcgcgggaaactaagtccagtgcttgcgggcgcaagagctgcgcggaggtccagcgagttttcggcagttgcagaaagatatcgacatccagtccggtctggtggctggcatgaccgccgttgaaacgcccaccagcgggcatccccatatcgccaatcagcaccgtacccatgcccagattgctcacctggctactcagacgctggataaacatcaccagatccgggtgaccgaaatagcgacgctgatcggtacgcatgacctgataatgttcggactgtatcggcagcgtgtcagcgccgacaatacagccattagaaaaactgcctatcgattgtgcgctacccggcacaggttgggttattttttgccacggcgtcgctgccaggctggcgctactggcaagcagagccagcagcgcaatcgcggttttattcattttttaccagcgtggaatatcagtcttcacatcggcattttgcgcccgttgccgtaacaggtgatccattaaaacgatcgccagcatcgcttctgcgatcggcactgcgcggatcccgacacagggatcgtgacggcctttggtgatcatctcaacttcttcgccaaagcggttaatggtacgacccggcacggtaatgctggaggtcggtttcagcgccatatgggcaatgatttgctgcccgctgctgataccgccgagaatgccgcccgcatggttgctctggaaaccgtctttggtgatttcatcgcggttctggctgccgcgcagcgccaccacgtcaaagccgtcgccaatttccacgcctttcaccgcgttgatgctcatcagcgcatgggcgatgtcagcatccaggcggtcaaagaccggctcgccaagtccggcaggaacgccactggcaacaacggtgactttagcgccgatggagtcgccctcttttttcagcgcacgcatcaactcgtctaacgcgtcgattttgtcggggtccgggcaaaaaaacggattttgctcgacctgcgaccagtctttgatatccagcggaatgtcgcccatctgggtcaggcagccacggatttcaataccaaatttctcggcgagatattttttggcaatagctcctgccgccacgcgcatggcggtttcgcgggcggaagaacgtccaccgccgcgataatcgcgcagaccgtatttttgttcgtaggtgtaatcggcatggcctggacggaaaacgtccttaatcgcactgtaatcctgagagcgctggtcagtgttttcgatcaacaagccaatgctggtgccggtagtaacgccttcaaaaacaccggagagaattttgacctgatccggctcgcggcgctgggtggtatagcgcgatgtcccagggcgacgacggtcgaggtcatgttgcaggtccgcttccgtcagcggaatgcctggcggaacaccatcgacgatgcagccgagcgccagcccgtgcgattcgccgaaggtggttacgcgaaagagttgtccaattgtgtttccagccatcacggctccgttattgttgtgtttgcgtgtttacttaatctttataaatcgcgaaatgttctcgtgcggcaataagctgctctttggtgagcataaacacaccatcgccgccgttatcaaactccagccaggtgaacggaacatccggatattgttccataagatgtaccatgctgttgccgacttcacaaatcaacacgccatcatcagcaaggtaatctgccgcgttaccgagaatgcgacgcgtcagtttcaggccgtcagtgccagatgccaggcccagttccggctcgtggcggtattcgtttggcaggtcggacatatcttccgcatcgacatacggcgggttagtgacaatcaggtcgtactgcactttcggcaagtcgcggaacagatcggaacgaatcggaatgacgttgtggatcagaccgtgttcttcgatgttctgttcagcaaccgccagcgcgtctggagagatatccaccgcgtcgacttctgcatccgggaaggcataagcacaggcaatggcgatgcagccgctaccagtacacatatctaaaatatgctgcggttgcttgctgataagtccggcaaatttattgttgatcagttcaccaatcggcgagcgcggcaccagcacgcgttcatcgacgtaaaattcatggccgcagaaccacgctttgttggtcaggtaagccaccggaatgcgttcattgacgcggcggatcacgcgttcaacaatacggtgtttttcgctggaggtcagacgcgcggtgcgcatatcttccggaatatccagcggcaggtagagcgaaggcaacaccagctgtacggcttcatcccacgggttatcggtaccgtgaccgtaccagatatttgccgcgctgaagcggctcaccgaccagcgcaacatgtcctgaatggtttgcagctcatttactgcttcatcaacgaaaattttatccacgtattcctccagggcatgatcgcaataatttcggcggctagtttgccatgaagatgacgataaatcagcattcacgcgcggtgagtgaggaaaaatacgtttaaaacgatcgattgcgctacgagtcgggtaaactgtaggaaaattagaaatagagacagataaatgaaaaagaaaacaacacttagcgaggaggaccaggctctgtttcgccagttgatggcggggactcgcaagattaagcaggacacgattgtccaccgaccgcagcgtaaaaaaatcagcgaagtgccggtgaaacgcttgatccaggagcaggctgatgccagccattatttctccgatgagtttcagccgttattaaataccgaaggtccggtgaaatatgttcgcccggatgtcagccattttgaggcgaagaaactgcgccgtggcgattattcgccggagttgtttttggatttacacggtctgacgcagctgcaggccaagcaggaactgggggcgttgattgccgcctgccgccgtgaacatgtgttttgcgcctgcgtgatgcatgggcacgggaagcatattttgaagcaacaaacaccgctgtggctggcacaacatccgcatgtgatggcctttcatcaggcaccaaaagagtatggcggtgatgcggcgttgttggtgttgattgaagtcgaagagtggctgccgccggagttgccctgaggagttgagcgcgttgcgccaggtacgggtaatggcaggggcgaatgcccctgcctggtgtatctaagggctacaactcattcagtatgtactggaaccggcaagtagaatcgattggctgcatactgctggtatcaacacgcacgaccatatcgtgtaactgtttgtccgttatagggtgtcgatttggcgtgaccgagacttccgccttgtcacatcccgacgcggtaaaagttatcatctgtgcaacccagcggcagtaaccacctgtttcattcatctgcgtactgtcgcacaacttcccatctttcatcaaatacgttgaaagcgttttctcaaccacaccgcccgtcgactgcagggtgagcagttttgacttactgacataattctcattccatgaaacgtcataaggttgaacagaaacggatggacaaatcgtgtcgtgactatcaggcccctgatacgtcacgccccctggagaggcttcagagtcattcataataaccaaccatggacaagaaaagtaagattcaatctctgcagagacaataacctcaaatgtataatacccgcagttccacccagacggtaatccaggacaacttgctttgttgatattttgatggtagccaatcagcttaaccgaaggggcaggaggaggaccactccagctcacattttgcaatatttccccagtcatgagccattgactacttttatattcaccaacgtacactgcggatggcatcattatttttaaattaaaagtcgcaatattacgcgaatcaccgttgtaaccgtagtaaacgtcaacgctatgcccggcagccatagcttctgtagtagcaataagcatgaccagagcgaacaaccatcgtagtattttcattttaaatatactcaaatgtcgcagttaaagaggcggtaaattcaccgatcgtcacatcacggccgcttttcgcctgtagccaggctctgaaattgatatcgttattgccattggttagcgcaaaggtcgccccatttgtattgttgatggcaacctgcattccgtcggttttttccatgccaattcccactccctgagcggttgatgacgtatccagtgccagaaaaccgggttgttcgctgtcttctacccccgtgagcgtgacttttacgttgtatcccgccggccctttgcaatctttcagcttaaagactacgggtacacgagcggactggcctgcaacgttcaaatcctgacgactgaccgtgggaaagcgcacctctgccagatattggccatccaccaccagcgcacaggatttacttaataaattaccggagaaatgcagattattatctgccgcgaataacgtgctactcattgccaatatcagccccgctaacaggacgtaaccaccggactgaatcattgatttattcattgataatccacccgtaatgttgcgtaagccgaaaaattcgtatcgcttaacacagcatcactcgcttttaccggtacggcctccagcttcggcttttgcgtaaaatcagtggcgttgatagcaagcggagtattgagtttaaaacgctgaccatcgtgctgaagctcgataccaaaaccgggtacatcagtttcaattgctgcatcattaaaactggtttgtgtaccagtccaggtgagggtcatctcccaatctggatgacgggtcgtcgagtcacaagtgagttcatatggcacctctttacgaccatagttgccgttgatgtcgtcgataatgagatcgcgaaattcgacttcaatggttttaccaccgctgatgctacaggttggcggtgacaataatgtcccgtgaaaggtgatgtcttcatcagcagcatgagctatggcgctactgacacaaagcagggttaagaaagtctttctcattgatagtccaccaccatggtcaaactggcgttaaactcgcccgcagcaagttgcgccccgcttgccttcacaggtacagccttcaactgtggctggttattgatattaaatggcgtccagctattttcaccgacggcaaacaatgagttatcggcgctattttctatccgaatgcccagcccggtgatattggtactgagtaccgtttcgccgttaatcgttgaggtattgcccttaagttgcatccgcaagtcgttagcaagactgtttgtgcagttcaacgtgtatttcgcatcttgccgataattggtgccatcaacgttatcagcaatcatattgccgaactctacctggctgcccttgattgaacagggtggcggagcatcgaccaacacgcgcagaattaaatccacgggtttactaccagccatagcagataaactacagacactgcataccagcagccctgcgcccactacaaacttttgactcataactccccccgtcatcagcctttgcggctctgctcttcatccacctggcagctgttgccattgcactggaagaacagcggcatccgtgcgccaaagtcgttgacgtaagtcagcaccggtacgctatccattttcacattcagcggtaccgtggttttcggctcaatgaccagaggcgagaaccctgcagctggattaccgtttttctgcgcactggcgttgctgataatcacgtagtacggcgttgggttattgacggtaaatgcctgaccgctgcgggtgagcgtcaccttgtgctgccacggacttttcatactgaccttttccagcgcctttggtcgccagaacaacttgatacgcgtttgcagcgcgatttgcagggtattgggtttgtttgattttggcgggatctcgcgcacgttaaagtagaacatgctttcacgatcggctggcaatttgttgatatccggcattccctgcacttttacctgcccgttcatcattgaatcgatgcgttgcactggcggcagcacagttaacggcgaggtgatcttgttacccttttcatcttcaatccagctttgagccagataagggagtttcggatcgttattacgcagcgtcacgctgattgatttgtcgctttcattaaatatcaaacgggtacgatctggcgttacagacgccagggcagacaaactggtagcgctaagcagtaacgccagcgtcatagcacccaatttggcagagcaaagtaaatcagacatggatcattccttaatcacgttattggttagctgaaacagaaacagggggatcggtgggtgtcacctgttgcgtctgctcctgaatgacaggctttatgtcatcaggaacaaccggcgcgacgttgcctttatgctggcatggcagtaacaagccgttaaacagatcggcaggcagcgggtccggcaggttgatatcgcaatgcgcaacaccactccagaacacactcatatgttcgccaggtttcaccccagccagatagacactaccgtcatcatcgacaaggcccactgtctgctcgttatcattttttacttctgcgccaaacggtggatggctgccatcttgtaaacgcagcaccgccatcgctttttgaccactgatgacggcaaatttgcggtagccaatggctccttcagttagcgtggcttgcaccaccgactgggttgcttcggcgttttccggcaatttgttgaggtcgatatacgcctgattgcgataataattgttaacgtcagaaacgacggctttaccaaacatattggtataaacagcagccccgttaccttccaccggaacatcggcaacgccatcggcatcaatcagcaggcgtgtcccgcccatattctgggtacggtgaagtgcgccgccgtgggtagtaagcgttgcgccgccctgtaacgacaagcccgcagaggtgtattgcccttcatggtagttcgcactgaggtcaacctgcgccagcgaaccatcatggctgtagtagccatcaacgctggtgtgtttgtcactggtgccgatgttcaactgatagtgagtcgcgtcatcgacacggctaaaataaccgacctggctgctgtccgtcccactgccatagttgccgttatagctaacggtactgttgtcgccccacggcatactgagcgaaatctacatgcccttatccgcccggttgtcatactcgtagcggtagccagtcagggaaacgctcatattacgaatgctgcccatattgaaatagtgggagagcatgatgttgtagtttgtctgctcctcacgatcccagtaggtatggcgggtatagttgagataaaccgaaacacccgcatcgcggaagttctggttataagtggcggtgtacatctctttgtcgttgcccgtacggaccatttcgctgtcactggcatccagatactcgctcatggtcataaagttctcttccgagaagcgatatccagcgaaagtgacgcggctgttgagctggtcaaagtctttggaataactcacacggaaggagttaccgtccagcgaacctttgccataagcggtgtctttatccagtttggtatgcgaatgagtaacatcaaacgcgaccgcgccgaaggtagacaaatcgcgaccgacgcccagcgccgcagactgatagttttcatcacccagcgcaccgccatataacgaccagccgttagcgatgccccaggaggcttcagcaccagagaaaaatcccccctcgacatggtggccccactcttgcggacgtcccatcatgatcttatagcgaacctggcctgggcgagtgaggtatggcatcgaggcggtgctgatgtcatattcctgcacctggccgttctgttcttcaatgcgaatatgcaacgtaccggagacggaatcaccaagatcctgaatacgaaacggtccagccggaacctgcgtttcgtaaatcacacgccccatctggctgacggtcacttttgctgtggtgtgtgccacgccggaaatgtctggcgcgtagccgcgcagattgggaggcaacatttgatcgtcagtgctgacactgccaccaacataattaaaaccgtcgaaaatatcggaattgaggtaatcttcgcccagcgccagtttggcttttaatgacggtaacgcccgccaggcataatagcgactccactcccattttttttgtgtgtcatcgccgccaaattcatcgtcatcatcattactgcgcgtatgttgatagttggtctgccagtcagcgcgcatacgccatggccccaggttaaccccgaccgtcccgttgccgctgatctcgttactgtcatcgccgccattttcttcgtgtcgtgtttgcgcagtgatgctgtagtccgcaatgatcccggagatgccatcatcccaacgagaaggtggatcccagtcgggccaggtatattcgaggtaagcctgcggtagtgaaatgactaatgcggactggcttaaatcagccttaatttccacgccttccagttgaccgggcttcaggcatttaccatcgtggctccattgcagatttttcgccacgtcttcttttaaaccaaactgcgccaccagttccggtgtcagacaagcatagcttttgctaacgtcatcttcaccagcataccagtaaatatcgtactcttccgccaatggctgtttatttagttgaacctgtaaattgtattttccgggctcaacatacccctggctggaaaaacgcttcagatcaatttttgtgtcgccttttaattccagaaaacgggaatcaaactgaatgtcgtcttcagcccagacactgctataactccctgacattgccagcgcaatgcaccacggaagaatccgtaatcgaaaaagagaatggtcaggcatacacgtttttatccgtttttattcttgttcggtcaaaatccatttaaataccccatagcagtgtcgctatgggggtatgccttacaggtaagtaatctggaaggtggtatttgcttcgaaattacccagatctggcgcatcagctgcgccgaccagccaggctttaaagttcagagtctgcttcgctttgcctttattagtggcagtatctttcacgattttctggtcaatacccatgccgcttttgtaagaggtacccagagagtcaccgatcgccaggctaacattgttaaatgccgcaccggtatcggtattgaaaatggtgtaataattgccgctatttgcagaagaaacggtaccagtaaaggtagtggtcattgtttcctgagtatcaaatacgcaatcttgcaggcgaatctggaaatttttcggcgtggtggtgccgttatttttcagtttttcggcaccgatatcacccatatcaacttccagtttgtgatcgtccggaacgatagaacacactgagtcttcaatggtgccgtaaaaacgtgcagtaccgttgttacccgcagcgattgttgccgtagaggtgaacgcgcccatcaccattgccgcagcaatagctgttttaacaaacttactcattatttgtccttaaactataaataattaaaatataaacattgcaatacattgattcagtcaatagccaatgtttatacccagccattgaatacggcatgcgatccaaaaaaacaggtcgtaaaaaatgtattcgttggtgtggggtcgaatagtgatgttttcactcccctgattcaatttaattttactaatgagtaaatgtagatttaattaatatattgataggggaaagattatcttaaggatcttctaaaaaaacacgaaatatatatttagaaaaaacaggaagcatatcaacaatgaatgccaatagcttaaaaaacaaacaatgaacatataatgcgattggcattaacccgcttttgtcgatataatatataaacactatagccagaatttaatcaagtttcaattacgtcctgcctgattattcaactctattttctccattatctgtattaataaatgataatgagtgtcaaacagacattattcatttcaacatgtaactttgggcaaaatcaagatacgcgcagaagaatactttccgaatgaaagttaaaggtgttttatttatagatggggagagtcttcgatagtagtgaggttgacagatatccgctgcctgatgagcaattatgcccaatgaatctacctcattgggcataatttggaactcatcagatagcttttgccatcttcagattacacgggctcatctgccagttgaatgtgccgtttccgctttcatcaagcgttacgctggcaatggccgaggtggtaaacataggcggcgtttcgcccggacataactcggcaaccagatacccgactaacggtaagtgagagatcaccagtaccgaagcaacaccttcattggtcaacgcctgcaaataggcactgaccagaccaacatcgccgcagggcgttaactccggcagaacttctgcactggaaggcaggttcagacaatcccctacttcttccagtgtttgctcggctcgcaggaacgggctcaccagaacgcgttcgatttccactttttgacctttcagccagttcgccatcaggcgagattcgtcacaaccattagtggtcagaggacgaacggaatcactggcggcatcgagggctgcgtcgccgtgacgcatgataaaaacttgcatattgcaccgcttttgttaaccagattcgcccgttttctttcatctgaaaccagagaaagaaaacggtggccggcattgtgccttatccattcaccgaatgaaacgctgttttttacctcaatggcgtaagtatagtcaatatgcgtttacattttgaccaacactccgccattcagcgcggattcatatagctttgaccttcttattgcaggtcagttgcagttgttttccaaaaactttccccacgcgcgcccatctcgaccaaacgctcgcaaggggtaaaacgggaaccatactgcgtggcaagtcgttgcattattgcaaccacttcgcccgcgccgagagaatcgatatagcggaacggtccaccgagaaatggcggaaaaccaatgccaaataccgcgccaatatccccgtcacgcacgctacggataacctgctcatcaacacaacgtactgcttcattcagcatcaacatcacacaccgttcagcaacctgcggtgcggagattcgcccctgcccttgtgtgccaatcagcgggtaaatggcgggatcgacctgttttttgcttttacgccctttctgaccataaagatagaaaccccggccattttttctgcctttgcgatcgtcgttcaaaattgaagaaacaacatttgcaggcgcgctaaaacgttctccataagcggcttccagtacaggaataattttagtcccggtgtcgattcctacctcatccaaaagttggattgggcctaccggaaaaccaaatttcactagcgcggcatcaatgtgctctacccgttcaccttgggtcaacatgcggatagcttcattaatgtaaggcgctaagatgcgattgacgtaaaaaccggctttgtcacgcacgacaattggcgttttaccctgttttttcgccagttttactgtggtagcgatggtttgcgccgatgtccccgcatgaggaataatctccaccagcggcattttttccaccggactgaagaaatgcaggccgataacttgctcaggtcgcgtggcgtgagcggcgatatcaccaatcggtaaagatgacgtattcgaagcaaagatggtatgagcggcgcaattttgctcaacttccgccaccatctgttgtttcaattcgagattttcaaacaccgcttcaataatcagatcgcgatgggcaaagccgcgatagtccgtcgttccggagattaatgccagctgtttgtcacgttcgctggctttgagatgacgacggcgaactttgccctccagctgatcccaactgtacttcagcgcatgatttatgccctgcgggttgatatctttaattctgaccggaatccccgctttacaagcagtgacataagcaataccgccgcccatcaagccaccacctaaaatccccacgctgtttaatggcgcaggcggcgcatcactgccgggatctttcttcacgtccgtactggcaaaaaagatactacgcagcgcctgcgattgtggcgtcatcgccagttcgccaaacgcccgagcttcggcgtcataaccgctgctggtgccctgcgctaatcccgtttcaacaacctccaggatgcgttctgtcgccggataattgccttgagttttgtgttctgttttcttgccgaccattttgaacagcagcgcacgacctaacggccccgccagaatacgctcgcgtacaggtagagggcgggaagatgggcgctccttctttgccagctcaacagcggcttccagcagaatggagtgcggaacaacgtcatccaccagccccagctttaatgcctgtttcgcccgaagttgttttccggtgaggatcatctctaatgctgtgctgacgcctatcagacgcggtaaacgctgggtgccgcctgaaccgggtaacaatccaagttgtacttcaggcaaaccgagcaccgttttaggatcgtcagtacaaacgcgaccgtggcacgccagcgccaactccagcccaccacccaggcaagcgccatgaatagccgcgataacctgaatgggcaaagcatgaatctccgccatcaactgttggccctgccgcgccagagcttccgcttcttgcgccgttttgcagttgccgatcatgttgatgtctgcgccagcaatgaagttgtccggtttagcggagacaaacaccacgcctcgcaactctttgttttcacggagttgcttaataatggcgcgcacctgcgaggcaaactccgccttcagggtattcattttctcacccggtacgtcgatggtgataacggcaatgttgtccagacgaacattaagggtaaacgctgatgtcatttccattattccgcctccagaaccattgccgcgccaagcccaccggcagcacaggcggtaactaaaccaaatccaccgccgcgacggcgaagttcatgcaatgtctgggtaatcatccgcgcgccggtcgccgcgaagggatgcccgtaagcaatcgaaccgccaagcacgttaaatttgctatcgtccacttcgccagtggcatgtgcacgccccagtgcttcacgagcaaaacgttcactacccagcaactgaatattcgccagcgtctgagctgcaaaggcttcgtgcatatcgatcaatgtcagatcgctcatcgtcaaaccggcacgctccagcgccagcggtgttgaccaggctggaccgagcaacatgtcctgccagacatcaatcgcagtaaatgcgtagctgcgcagataccccagcggcaccagccctaattctttcgcccgggattcagtcatcaggatcaccgctgccgcgccatcggtcagcggcgtactgtttgccgccgttaccgttccgtgtttgcgatcaaacgccgggcgcagctttgcgtaatcggcaagcgaggaattaccgcgaatattgttgtcttcgacaagcggttgtttataaggagggataaaggcagtcatcacctcttctttgagttttccgtctgaccatgcctgagcggcacgctgatgcgaacggtgcgctaatgcatcttgctgttctcgggtgatgccgtaggttttcgccatttgctctgcggtgtcgcccatccgcaagccggtagaatattctgctaccgcaggtggtacgggcattaagtcgcgcaaacgcaggcgagagaagagtttcagtcgctggctcatggtacgagctttgttgacatcaaccagcacgcgcgccagttttttactgacgccaattggcaataccgaagaggaatctgccccaccggcaatccccgctcgaatagttcccgccatcaggctttctgcgacgtttgcaactgcctggaaactggtagcgcaagcgcggctgacgctgtaagcatcggtatgtacattcattcccgtaccgagaacaatttcacgcgcaatgttgggggcttcaggcatttgtacgacctgaccaaagaccagttgttcaatcacttcggcggggatctcgctgcgtgccagcagttcgcctaccaccatcttccctaaatcaaccgcgggaatgccatgaaaagccgtcgcctgacgggcaaaaggcgtacgtaaaccgctaacaatggcgatacgatcgccctggcgggtaaccagcggtaaaacctgacccataacactcccctgtaaaaaaataaataaagtggtctgacctgatcatagtcttaaccatttttttacatttagccaagtggagaaaagggaaagtgggagctatgacacagagagaaaagaagaagagaaaagaaaacgcccctgccagcaactgacaggggcgtacgtacccgagaggaattaacgcagacccagctggaaaatcagcatttcagcttcgcaggcaaaagtgaaatcgatatccaggcgcacaccgtcagactcttcagtgaaagtcggggtgattttgcaaggttcagattccacgctacgggctttttcagtcagcgccgccagcgtttgctctgcttctgcgcggtttgcaaacacgcggctgtaagacgcggtgcagtcggagttgtccataatggtgccaacatccatacagcagcaaaccggggtttcatcagcactacatttactcatcgttgatttcctctgtatgtgcacccaaggtgccagataaacgttgtggatattttacgcttccggaaagtgctgctccagttgttaattctgcaaaatcggataagtgaccgaaatcacacttaaaaatgatctaaaacaaaattcacccgaatccatgagtgcgccacctccaaattttgccagctggatcgcgtttcttagatcatatttgaaaaaagatagaaacatacttgcaacattccagctggtccgacctatactctcgccactggtctgatttctaagatgtacctcagaccctacacttcgcgctcctgttacagcacgtaacatagtttgtataaaaataaatcattgaggttatggtcatgagccagaaaaccctgtttacaaagtctgctctcgcagtcgcagtggcacttatctccacccaggcctggtcggcaggctttcagttaaacgaattttcttcctctggcctgggccgggcttattcaggggaaggcgcaattgccgatgatgcaggtaacgtcagccgtaaccccgcattgattactatgtttgaccgcccgacattttctgcgggtgcggtttatattgacccggatgtaaatatcagcggaacgtctccatctggtcgtagcctgaaagccgataacatcgcgcctacggcatgggttccgaacatgcactttgttgcaccgattaacgaccaatttggttggggcgcttctattacctctaactatggtctggctacagagtttaacgatacttatgcaggcggctctgtcgggggtacaaccgaccttgaaaccatgaacctgaacttaagcggtgcgtatcgcttaaataatgcatggagctttggtcttggtttcaacgccgtctacgctcgcgcgaaaattgaacgtttcgcaggcgatctggggcagttggttgctggccaaattatgcaatctcctgctggccaaactcagcaagggcaagcattggcagctaccgccaacggtattgacagtaataccaaaatcgctcatctgaacggtaaccagtggggctttggctggaacgccggaatcctgtatgaactggataaaaataaccgctatgcactgacctaccgttctgaagtgaaaattgacttcaaaggtaactacagcagcgatcttaatcgtgcgtttaataactacggtttgccaattcctaccgcgacaggtggcgcaacgcaatcgggttatctgacgctgaacctgcctgaaatgtgggaagtgtcaggttataaccgtgttgatccacagtgggcgattcactatagcctggcttacaccagctggagtcagttccagcagctgaaagcgacctcaaccagtggcgacacgctgttccagaaacatgaaggctttaaagatgcttaccgcatcgcgttgggtaccacttattactacgatgataactggaccttccgtaccggtatcgcctttgatgacagcccagttcctgcacagaatcgttctatctccattccggaccaggaccgtttctggctgagtgcaggtacgacttacgcatttaataaagatgcttcagtcgacgttggtgtttcttatatgcacggtcagagcgtgaaaattaacgaaggcccataccagttcgagtctgaaggtaaagcctggctgttcggtactaactttaactacgcgttctgataacgcgttcgcctggataaagtcacctgcatagcaggtgactttaactcccccacttcaccgaaagtagtgtcctcattgcttacctcctgagttttgcaaacagcctgttggcagcttgccctttcaaatcaataagcggtatccacagacaaacctgaagggaaaggcatattttcaggcgttctgctcgtccttctcaaagagtttacttttctgcatttccaggatactccccccccctggctattgtgcgctcatacactcaaattaaagataggttctaaataaatgagcgttttttgatagtctatttcattaggtaatatatatttgtaacaaatcaatcaaaatggaataaaatcatgctaccatctatttcaatcaacaataccagcgcagcttacccagaatccatcaatgaaaataacaatgatgaagttaatggattagtacaagagttcaaaaacctttttaatggtaaggaaggaataagcacctgtattaaacatctacttgagcttataaaaaacgccatacgagtaaacgacgatccttatagatttaatattaataattcctcagttacttatattgatattgactccaatgatacagaccatattactattggtatcgacaaccaagaaccaatagaattacctgcgaactataaagacaaagaactcgtccgtactatcattaatgacaacatagttgagaagactcatgatatcaataacaaggaaatgatcttcagcgcattaaaagaaatatatgatggagatcctggttttatcttcgataagatatcacacaaactcagacatacggtaacggaatttgatgagagcgggaaaagcgaaccaacggacttatttacctggtacggtaaagataaaaaaggcgactctctcgctattgtaattaaaaataaaaacggaaatgattacttatctctcggttactacgatcaggacgactaccacattcaaagaggaattcgtattaatggtgatagtctcacccaatattgtagtgaaaacgccaggagtgcttcagcgtggtttgaaagcagtaaagctatcatggcagaatcatttgcaactggttccgatcatcaggttgtaaacgagctcaacggggaaagactgagagaaccaaacgacgtttttaaacgttatggtcgagcaataagatatgattttcaagtggacgatgcaaaatataaatgcgaccatctaaaagaaatagtttctactttagtcggtaacaaaattaacgttggccattctcaaaaaatatataagcattttaaggatctcgaaggtaaaattgaagaaaggcttcaaaatcgccaggctgaatatcaaaatgaaattaatcaaccatctgcgccaggtgttaattttgatgatatttaaaattatttttccagttttttgatttttcaacagctgaatatcggaaatagtcagtgacgaacatcagtatttttacataattacgtctaggtcattgtcggtttatctccttttacttgtggtaattgagggataacaacaaaaaaggtgagttttgcgactcaccttttttatttgtttcttattcagaatcaatatcttttaaatcatcctgaatcgcttgtgcgttcggattttcctgcggtttgagttcgccgccattagcgatgaaatcatgacgctggaagtacgcttcgcgcaccataatataaggatcggacgactgacgcagcagaccatcggaatccagcagctgagcgcgggtttcgatcccttcaagcgtccatttacccacagacatcggccaggtcagccaggaaagaaccgggtaaaaaccatccgccatatcaccaccgtcatcacgcagcgtgaagctaccgtagaacggtaactgaacgtaaggcccataacccacgccataatgaccaagcgtactaccgaagcggtgaggttcagtccgttgcagtttcgggttcgccatccctgcaacatcaataaaaccgcccatccccaaaatggtgttcaggaaaaagcgggtaaagtggaccatcccctgataagggtcgccctgcaagaagtagttaaccatcaccgcaggttcttcaaggttgccagtaaagttgctcaaaccgttacgcgccggttgcggaacataatcacgccaggcgacagcgaccggtcgaacaatatacgggtctaatacattgaagttgaagttgtacatggtgcggttgaacccttctaacgggtcagaacgcccttgctgatctgtaccggaactcgcacaccccaccagaagcgtagttcccagagcaagcgccgacaggcgaagcttcataaatgtctccctgtttttttatggcttatgcagtttgccatccatgacggaacgataccgtatccgcctgtttaggtgtgggcgattgtaacagcacgtcaactgatgtccagacgccctgatttgctgatttgatcatagcctggtaatcgccgccctgtaggctacttgattctatagaaacagaaaaaggcaaacgcagccttttctacattttcagagtaactcccgtcagttgcgagcaaaaaagccgctacgctttagctatacgtgctaattcaagagaagagaccatggacaacgacaaaattgatcaacacagcgacgaaattgaagttgagagcgaagaaaaagagcgcggcaaaaaaatagaaatagatgaagaccgactcccctcccgggcgatggcaattcatgagcatatccgccaggatggtgaaaaagagctggaacgcgacgcaatggcgctactgtggtcagccattgcggcgggtctgtcgatgggcgcttcgttactggcaaaagggatatttcaagtcgaactggaaggtgtgccgggcagcttcttgctggagaatctcggttatacctttggttttattatcgtcattatggcccgccagcaattatttaccgaaaataccgtgactgcggtactacccgtcatgcaaaaaccgacaatgagcaacgtcggcttacttatacggttatggggcgtcgtgctgctgggtaatattctcgggacaggtattgcggcgtgggcatttgaatatatgcctatcttcaatgaagaaactcgcgatgcatttgtcaaaatcggcatggatgtgatgaagaacacccccagcgagatgtttgccaacgcgatcatttccggctggctgatcgccactatggtttggatgtttcctgcagcgggtgcggcaaagattgtggtgattatattgatgacctggcttattgccctgggtgacaccacccatatcgtggtcggttctgttgaaatcctctatctggtgtttaacggtacgctgcactggagcgatttcatctggcccttcgcactacctactttagcggggaacatctgcggcggcacctttatcttcgcgttaatgagtcatgcacagattcgtaacgacatgagcaataagcgtaaagcagaagcacgccaaaaagcagaacgtgcggaaaacattaagaaaaattataaaaacccggcataaatggcgagggtttaagcaatcgagcggcagcgtacttaccccgcactccattagcgggtatactcatgccgcattgtcctcttagttaaatggatataacgagcccctcctaagggctaattgcaggttcgattcctgcaggggacaccatttatcagttcgctcccatccgtaccagtccgcaaaatcccctgaatatcaagcattccgtagatttacagttcgtcatggttcgcttcagatcgttgacagccgcactccatgacgggtaaaaagtggataaaataattttacccaccggatttttacccatgctcaccgttaagcagattgaagcagcaaagccgaaagaaaaaccataccgccttctcgatggtaatggcctgtacctttatgtccctgtgtcagggaaaaaggtatggcagcttcgctacaagattgacggtaaggagaaaatcctgaccgtcggaaaatatccgcttatgactttgcaggaggcaagggataaagcatggactgcgaggaaagacatctcggttggcatcgatcctgtaaaggcgaaaaaggcttcgtctaacaacaattcctttagtgcgatttacaaggaatggtacgagcacaagaagcaagtatggtcagtagggtatgcaactgaacttgccaaaatgtttgacgacgacattttacctatcattggcggccttgaaattcaggatattgagccgatgcaactgctggaagtaatccgcaggtttgaagatcgcggtgcaatggaacgagccaacaaagcacgcagaagatgcggcgaggttttccgttacgctattgtcaccggaagggctaaatataacccggcacctgaccttgctgacgccatgaagggataccgcaagaagaacttcccgtttcttcctgcagaccagatcccggcattcaacaaagcactggcaacattttcaggaagtatcgtatcgctcattgcgaccaaagttttacgctacacagccctaagaacgaaagagcttcgttccatgctatggaagaacgtcgattttgaaaataggattatcaccatcgacgccagtgtgatgaaaggacgcaaaattcatgtggttcctatgtcagaccaggtagttgaacttctcactacgctaagctccatcaccaaaccagtctcagagtttgtttttgccgggcgcaacgataagaagaagccaatctgcgagaacgcggtactgcttgtgatcaaacaaatcggctatgagggtctggaaagcggtcacggattcaggcatgaattcagcacgattatgaacgagcacgaatggcctgctgacgctattgaagtgcaactggcacatgcaaacggcggatctgtgcgtgggatttacaaccatgctcagtatctcgataaacgcagagaaatgatgcaatggtgggcggactggcttgatgagaaggtggagtgagcgaccttaacaactatcgaatagcacaaagtcttgcaatccagtgcaaagctttgtgtgtataagttttgtctcatcaaccacagcaagtatcgatcgattaagacttggatgatagacttcattcctttgattattagctgatagaagaaatgttaaagctatttgcaaagtacacctctattggtgtgctgaacacccttatacactgggtggtttttggtgtttgtatctatgtcgcgcatacaaaccaagctcttgcaaacttcgcaggtttcgttgtggctgtgagctttagcttcttcgcgaatgcaaaattcacattcaaggcatcgactacaacgatgcgctacatgctatatgttgggttcatggggacactgagtgctactgttggatgggctgctgatagatgcgcacttcccccgatgataactcttgtcaccttctccgccatcagcctggtgtgcggtttcgtctattcaaagttcattgtctttagggatgcgaaatgaagatatctcttgtagttcctgtcttcaatgaagaagaagcgataccaattttttataaaacggtacgtgaattcgaagaattgaagtcatatgaagtggaaatcgttttcataaatgacggcagcaaagacgctacggagtcaatcattaatgctctggctgtttcagatcctctagttgttccgctgtcatttacacgcaactttggtaaagaaccagcattgtttgcagggttagaccatgcaaccggggatgcgataatcccaattgatgttgacctgcaagacccgattgaggttattcctcatcttattgaaaaatggcaagcaggtgctgatatggttcttgctaaaagatctgaccgctcaactgatggacgcctgaagcgaaaaacggctgagtggttctataagctccacaataaaataagcaatcctaaaattgaagagaatgttggtgatttcaggctgatgagccgtgatgttgtcgaaaatattaaacttatgccagaacgaaaccttttcatgaaaggtattctgagctgggtaggaggaaagacagatattgttgaatacgtgcgagcggaaagaattgctggagatacaaaatttaatggatggaaactttggaatttagcacttgagggtattacaagcttttccacattccctcttcgcatctggacatacatagggttagtggtagccagtgtagcatttatttatggggcgtggatgattttagatactatcatatttggaaatgctgttaggggatatccttcactacttgtttcaatactgtttttaggtggaattcagatgattggaataggagtattaggtgaatatattggacgcacatacattgaaaccaaaaaacgcccgaaatacatcatcaagagagtcaaaaaatgaataaagcaataaaagtatcattgtatatatcttttgttttgattatttgcgccttatctaaaaacataatgatgttaaatacatctgatttcggaagagccattaagccattaattgaagacataccagcatttacatatgacttacctttattgtataaattgaaaggtcatattgattcaattgatagctatgagtatataagttcatatagttatattttgtatacatacgtcctgtttattagcatttttactgaatatcttgatgctagggtgttatcgttatttctaaaagtaatatatatttattcattatatgcgatatttacttcatatataaaaacagaaaggtatgtaactttatttacattctttattttagcttttcttatgtgttcttcatcaacactgtcaatgtttgcatcattctatcaagagcaaatagttataattttccttccatttttggtgtattcattaacatgcaaaaacaataaatctatgcttttgctatttttttcgttgctaataatatctactgctaaaaatcaatttatattaaccccactaatagtgtattcatattatattttttttgatagacacaaactaattattaaatctgtaatatgcgtggtgtgcttgcttgcgtcaatatttgcaatatcttattcaaaaggtgttgttgaattaaataagtaccatgcaacatacttcggtagttatctttatatgaaaaacaacgggtataaaatgccatcgtatgttgatgataagtgtgttgggttagatgcctggggtaataaattcgacatatcatttggcgcaaccccaacagaagttggaacggaatgtttcgaatctcataaagatgaaacgttttcgaatgcactctttttattggttagcaaaccaagcaccatcttcaaacttccatttgatgatggtgtgatgtctcagtataaagaaaattatttccatgtatataaaaaactacacgtaatatatggagaatcaaacatactaacgactattactaacataaaagacaatatatttaaaaacattagatttatatcattgttattattttttattgcttctatttttattagaaataataaaataaaggcatctttatttgtagtatctctttttggaatatctcaattttatgtgtcatttttcggggaaggatatagagatttaagcaagcatttatttggaatgtatttttcgttcgacctttgcttatacataacagtcgtttttttaatttataaaataattcaaagaaatcaagacaatagcgatgtaaagcactaagtttaaattgcgcgccaatcatggcgcgcacaagctataataccaacctaatttctcctcctcttagagtgactatatctcctgatagaattgcggtattgactatcaaatgccctgattcgttgtttattgtaatatctcctctatctgcagacgataacttaaatgcatcattgcccacaacaaaccccctccagaaccaagtgctgatattatcatcaacagtgatagatacatatactaactgattatcgttataagtgattcctgtcttatacttaacataaggacttccactttgattctcgatagacacataacatccaggggttatgtttgtatgcgtcccgcgactatcgccccattaacgccatacgataaatgggatggtgagaaatgggtgacggataccgaggcacagcatagcgtcgcagtagatgcagcagaagcacagcgccagtcgctgattgatactgcaatggcttccattagtctgattcaactgaaattacaggctgggcggaagctgatgcaggcagagacctcccgacttaacactgtgctggattacattgacgcggtgacggcaacagataccagcaccgcgccggatgtcatctggcctgaactgccggaggagtaggccattcaatatctggcgcactggaagtatcgaccagctccagtgcgtccagataatccagccacaaattatattgcgccagttcctcacctttcagacgaccaatagccgctttaccagcccattgtttactgttcatataatcgttggcctgattaatcaattgctgctttttcagttcggctgcagcaatctgttcctcatgtgttggtggtggaatttcagaccatgcaggaaaaccattttctccagcgatacggatttttcctttcggcggtaatccggaaaactcaatatacacttgctcatcaacttcaacagcatcatctggccatgagccagcttgcgtgtaatcctctttcatctccaagggatagaaagagtttgtagtcgcggaatatatgtaattcatttttcactccataaagttaaaagaaattaacaccctaatgcgaaaaatgaagcaccgataccgggtacgcctgctctggaaataaatttcaccgggtcctggttataaccggcacaagctatatagccaacatttgcactgccgggagtgtaatcctgagtcgcaaatacccgcagacatctattcggaaatgcaatcggaaaataggttactgtgtcctgagacgtcagcggaacatcaattggcccccattgaataattaaaccggatggcaatttttgatatccaggaactgaagcagaaagcataaaactacccatatcaggtatctgattcgcccctgtccctacatttcttttagccgcttctcccaaaccaaggttttcgagagccttttgcaccgtgccgtccaatttgatatcgccaaacggattcttgcggcttaacagcagcgcacgaagcgcggtaagcagctggtcatgccgccccttctccaggctggcaccggaggcctccacaacgctgcaaagctcctcctgcaacatgtcaaagtagtcatcatccagatcggtggcaggcgtgccggtctgggggttaccacgggtacgggggattaccaaaggcagcacctttaagctccgcaagacgttctgaccagtcatgcgccagcgcgttgtcttccgcagtgtaatacgcggcacatttggcgttatcaccatcagtaaacagatccagaacaaacgggccaaacagggtgttaattccccagaaaatgttgtccggcgtgcgccactgatcgcccacttccttcagttcatgggctggtttgttccgcagctccaccagcgcctggcaatatttattactcattaagcccccacgtaattccctgagagataccactcttcacctgatgcagcccgcttactgcttttccgtaaacaccgttcacgacgcgccagaaaattgtttcgttctggctgggagtggctttcacggaatgccgccatccacaccgttgcagcacgacggtataagcccctggactccagttcttccgcctggcgggtcaggcacaaaatcacccgcgggtcgttagtgccgacatagaaattgcgcacaggtctggtttcacgaactggttgtggttccggatcctgcgctctctcagtcaggcgcgggaaatgtctgtgtgtatctccttcacaacggtgagccacacgcccactctgacgtaacttgcttgctgactgcagaacgcgctgccgtgagtaacctgcaaaagcatccgcaatgtctccggaagtacagcccggatgggcttcaatgaatttctgaacgtcattcaaaagactcatgctcaccccctgaatcctgccgggatctggctgtagtccacattgtcgtaactggctttgaagtacgggtcttcgcgtttttctgtgtacgtgctgacggacggcgataagcgcagggaaagctcatcccatttttcccgcagcttcgacgggctgagcacgttacggcaccagaacggatcgcggctgacgcggctgtacatctcgcagatttgtttgtgagtacgaccatcctgcacacacatcaggcgaatttcgtttgcccaggctgtccagttcggttctttgggacgaaccacctcgccgtcacattcggcggcctgctcgtacagggcgatgatttttttccagagccactgtgcgcaggtcaaatcatcctgcgttccccactggcgctttttagggctgaatacaaccgcatcaggatggcgagttaaaaaatcctgttcatccgtctgcgtgtccggttgcgaagcgtccggacgagaaggttttttatctgacggatcatgttttgattttactgacggatccccgccagattctgacgggtgaaaacccgattttttgccagatttcgacgcatcaaattttgacgggtcagattttgatgcgtcagattttgacgggtcagagtctgacagttgagaaaatgccgctgcctgaagcttcgcaacgttaagctgataaacattcgacgcattgcggttatgatgaggagcagcaaaatggctagcgaacgcagtactgatgtgcaggcatttatcggggagctggacggcggcgtatttgaaaccaaaatcggcgcagttctcagtgaagtcgcttccggtgtgatgaacacgaaaaccaaaggtaaggtctcactcaacctggaaatcgaaccatttgatgagaaccgtctgaaaatcaaacacaaactctcatatgttcgcccgactaaccgtgggaaaatttccgaagaagacaccaccgaaacgccgatgtatgtcaatcgcggtggtcgcctgactattctgcaggaagaccagggacaattactgactcttgccggtgagcctgacggaaaactccgcgcagcaggtcattaatatcattcttaattaactaattatttatctcatcactgaatatcttaatatagtgaggacttattatgtctcagaacttagacgcaaccgcaattaatcaaatccatgcccttatttctgctcagggtgttaatgaaattatcagtaagattggtgccgatgctgtggcattgcctgagaatttccgcattcatgatctggaaaaatttaatttaaatcgcttccgtttccgtggtgcgctttccactgccagcatcgatgactttacccgttattctaaagatcttgcagatgaaggcacccgctgctttatcgatgctgataatatgcgtgccgtcagtgtgcttaacctgggtactattgatgaaccaggtcacgcagataacaccgccactctcaaactgaaaaagacagcaccgttctctgccctgttgtctgttaacggcgagcgtaactcccagaaatcactggcagaatggattgaagactgggccgactaccttgtgggctttgatgctaatggtgacgccattcaggcaacaaaagcggctgcggcaatccgtaaaatcacgattgaagcaaaccagaccgctgattttgaagataatgacttcagcggcaaacgctccctgatggaatctgtcgaagcgaagaccaaagacattatgccagtggcatttgaatttaaatgcgttccgtttgaaggtctgaaagaacgtccgtttaaattacgcctcagcattatcactggcgatcgtcctgtactggttctgcgcattattcagctggaagcggtgcaggaagatatggctaacgaatttcgtgatctgcttgttgagaaattcaaagacagcaaagtagaaacctttattggtactttcaccgcctgatttcattactgcaaatgcccctgcgggggcatttatggaaacgtaattaactcaataatcaccggatggtgagggcttccttttacccaaactcagcgcggtgcagcgcatatacgtggagaacaaaatgtcatttattaaaactttttccgggaagcatttttattatgacaagataaataaagacgacatcgtgattaacgatatcgcggtttccctttcaaatatctgccgctttgccggtcatctttctcacttctacagtgtcgcccaacatgcggtgctttgcagccagctggtgccgcaggaatttgcttttgaagcattaatgcatgatgcaacagaagcgtattgccaggacatccccgcaccactgaaacgccttcttcctgactataaacggatggaagaaaaaatagatgcagtaatccgtgagaaatacgggttacctcctgttatgagcacgccagtgaaatatgccgatctcattatgctggcaaccgaacgccgtgatctcgggcttgatgatggctctttctggcctgtactggaaggcatcccggcaacagagatgttcaacgtgattccactggcaccgggtcatgcctacgggatgtttatggaacgttttaacgatttatcggagttacgcaaatgcgcatgaatgttttcgaaatggaagggtttcttcgcgggaaatgtgtaccgcgagatctgaaagtgaacgaaacaaatgctgagtacctggtacgtaaattcgacgcgcttgaagctaaatgtgcggcactggaaaacaaaataataccagtgtcagctgaactgccaccagcaaatgaaagtgttctgttatttgatgctaacggagaaggctggctgattggctggcgttctctctggtacacctggggacaaaaagaaaccggagaatggcagtggacatttcaggttggggaccttgaaaacgtcaatatcactcactgggcagtaatgccaaaagcaccggaggctggagcataatgaccacatttaccaataaagaactgattaaagaaatcaaagaacgaatcagcagcctagaggttcgagacgatattgagcgccgtgcttatgaaatcgcactcgtatctctggaagtagagccagatgaacgcgaagcctatgaattattcatggaaaagcgtttcggtgacttagtagatcgtcggagagcaaaaaacggcgataacgaatacatggcatgggatatgactctcggttggatcatctggcagcaacgagctggtatccatttttcaacaatgtcacaacaagaggtgaaataatagagccatacagcctcacactcgatgaggcctgtcagtttcttaaaatatcctgatctaccatcgccgtcatagagcgtatttttattacctgatttgcaggttcgattccctattcggagatagcactcatgcaacacgaactacagcctgattcactggttgatttgaaattcatcatggctgatactggctttggtaaaaccttcatctatgaccggattaagtcaggcgacctgccaaaagccaaagttatccacgggcgagcaagatggttatatcgtgaccattgtgaattcaaaaataagctcttaagccgcgccaatgggtaaaatagcgggtaaaatatttctcacatctaaaaaacaccattccaatcaatcccctgctgcttcaagtagatgtctgcaggggacaccatccttgtgtttatccctaaaaccacataaaaaccgtaaattaaattcgaactagcaggccgaataaggcacaccaggaactcgtggttttattcattatgaagtggtttttacctgttctcttagccagataataaacgcttcaatttttggccactgcctgcccggtaatgtggtgatgtaataatgctgatggcatttcaccgtcatatcgccaaacggcgcgacgagctcaccactggcaagccttttttgtaccaggcgttttcttcccatcgccaccccaatatgattcatcgcggcaataacagctaaatcagaacgatcaaagccaattccagaagatgtcggcaaattaaccgcataatgttgcgcccaactatgccattcatccgtaccggagtcgttgctccatgcctgtctgtcatggagcaacgtacagtgacacaggttaattaccgtgttggttaaagcatgtctttgagcgtattccgggctacatactggcaggatttcttcatccatcagaaagtgatgagtgagttgcgctgacggcgcatcatcaaagtagatcgccaaatcgattccggcacgttgcagattgacgttgtcattaccagtgagcacggtgagcgaaatagacggataccggcgtgtaaagtcacctaatgcgggcaccaaccagcattgggcgatagagggccgggaatacagagttaacgttcccgataactcctgatttttgatatcaagaatttcctggttcagggtatccagcgacgattttagcgcccaataaacacgtttcccctcgtgcgttaattccactttgcgatgggaacgaacaaacaactgaatgcccaattcttcttccagctgattgatacggtgacttaccgcactggggctcagcgacaattcctctgccgccagggcgaaggactgatgcctggcagccacttcaaaagtatgcatttttgataattgccagccgttaagcagccgatttcttatttcacgaaggggttccataatcacctcatttttcgcttaagtgtaaaaaaatagcggcaaaatttcagctatgagatgagctaaagtgaaccatatctcaattcaccttcatttttagatgtaaatcactccattgatgcaatttacctcatgtgaaaggcaaattttatcgtttgtcagcctgcgttgtttttttgtccaatatcatcaggttaatcacaggggaaggtgagatatgcactctcaaatctgggttgtgagcacgctgcttatcagcatcgtgttaattgtactgaccatcgtgaagttcaaattccacccgtttctggcgctgttgctggccagcttcttcgtgggaacgatgatgggcatggggccactggatatggtaaatgctattgaaagtggaattggcggaacgctggggttcctcgcagcggttatcggccttggcacgatactgggaaaaatgatggaagtatccggggccgcagaaagaattggtctgacacttcaacgctgccgctggctttcagttgatgtcattatggtgctggttggcctgatttgtggcatcacgctgtttgttgaagtgggcgtcgtgctattgattcctctggctttttcaattgccaaaaaaaccaatacctcattattaaagcttgccattccgctatgtaccgcattgatggcagtgcactgcgtggttcctccacatccggctgctttatatgttgccaataagctgggcgcagatatcggttcggtgatcgtctacggtttgctggttgggctgatggcatcactgatcggtggcccacttttccttaaatttctgggtcaacgactgccctttaaacctgtacccacagagtttgcagatctcaaagttcgcgatgaaaaaacactaccgtcattaggcgcaacgttattcaccatactgctacccattgcgctgatgttggttaaaacgattgccgaattgaatatggcgcgtgagagtggtttgtatatcttggttgagtttattggcaaccctatcactgccatgtttatcgccgtgtttgtcgcctattatgtgttgggtatacgccagcatatgagcatggggacgatgctcacacatacggaaaatggcttcggttctattgctaatattttgctgattatcggggccggaggcgcattcaacgccattttaaaaagcagcagtctcgctgatacgctggcagttattctctccaatatgcatatgcacccgattcttctggcctggttagtggctcttattctgcatgcggcagtgggctccgctaccgtggcaatgatgggggcaacggcaattgttgcacccatgctgccgctgtatcccgacatcagcccggaaattattgcgattgctatcggttcaggtgcaattggctgcactatcgttacggactcgcttttctggctagtgaagcaatattgcggcgctacgctcaatgaaacatttaaatactatacgacagcgacatttatcgcttcagtcgtcgctctggcgggcacattcctgctgtcatttatcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatcgcaatcctttccctgggtgagcgatgctgccgatggcgcagacttaagatccccggtcttacccgctataaccccctccttttatcatcacccaacgcctttcgctgtaaacggcggtttcgcaaaccaaaccaaaaccgtaagtaagataaaagcaatagccgccatacggaaaatctcatttgcagaaatagaaagtgactgctgggttatttcattattaatttcattaagaactcctgaaagcgaaccataatatttatccataatttgtgacgatgaattaaacacggggttaaattgatcgatggttgctgtcaactgactatggtgtaacgattcgcgtcgtccccacagcgtcattgtcaacgacgtaccaactgatcctgacaaggtacgaaaaaaattactcatactcgaggcattggcaaatttattatctggcaagcctgaaaacgaaatcgttgttaagggtaaaaagaaacaggcaacggcgaatccctgaaaaaactgcggcaaaatgatgcctgtaaaatcaatcgttggcataaatgtcacagaacgccagtaatagcaaaccgcatacatcaaaaaactaaatgtcactaacaaccgcatgtctattttgttgccataacgtcctatcaaaggtgaaattaatagtggcatgatgccgatgggcgcataagcaagtccggcccatatcgcattataccccatcgtttcctggagtaactgcggcataaggacgatcgctccagagtaaaataaatacgcgcatgtgatactcacaataccaatggtgaagttacgggacttaaacaaactgagatcaagaatcgggttctctgaggtcgactcccaaatgactaaagagatcagagaaataactgatactactgttaatattattattgtactcgagttgaaccaatccagatcgcgccctttatcaagcataatttgcaagccaccaacaccgagcactaacagggtcagtcctggtagattcattttgaccggtgaagtctcagtttctcttcctttaagtaaggttaagcataatgtcaggacgataatccccatagggacattgattaaaaatatccaaccccagctaaagttatcacaaatataaccgcccaatatcggcccacatatcggagcgataatcacggtcattgaccataatgccagagcaaatgttcttttttctggcggataattccttaataataaactctgtgacagtggaattaacggccccgccattaacccctgaacgactctaaaaaatatcagcacatcaagattggtcgataggctacacattaatgaagacagcgaaaaaaaagtgactgaaagtaaaaataatcttaattcgcctattctttgtgccaacctgccagtaacagggatcgcaatggcatttgctacaccaaacgaggtgataacccaggtgccttcgtctgttgatgctcccagaaagccagatattgtcggtattgcgacgttagaaatagtggaatccaacatttgcataaatgtcgctaatgacaatgcaatagtgacgcaccataacgtcccaccggttaatggtgccggagttgatttagtgattgccattaaagttgtccattatgcgaaataatgttgctaatttctttttctatcggactggtatcgataactaaagccttactggtataagccggcatggaggtcacggttgaagccagctcaggcatctcggcaatgtcttcgttcttcgtatcaatagttgctgtcatcgataaaccaatacgcaaggggtgttccatgagttcttttggatcaagagaaacttcaaccggtacacgctgaacgattttgatccagttccctgtcgcattttgtgcaggtaataaggagaacgcattgccggttcccatattgatccctgtcacccgaccatgaaacacaacattttcaccataaagatcgctgataatattgaccgattgaccaatccgtacatccgtgagttgtgtttctttaaagttggcattaacccacatttgacgtgccggtacgacagccattaacgattgtccggggctcactgtttcgccgacctgaacacttctctgggcaatatagccggtaaccggactcttaatatccgtacgtttaagcgccaaccaggcttctttagttgcatccgccgcttcaacgacttgtggctgacggtttaatggtgtgttcattactaaagctttattcgctttataagcctggatagcggcattcaatgccgctttgctacttattaacgtatctttggtatgctccagcgtttcttttgaaataaccccctgcttcgctaacggcactcgacggttataatcttctaaagattgttgatactgaatacgtgctgaagcgacttcggcactgtattgtttatcctgtaagtatagtttattcgtttgccgaacaatatttgccagattatttttagctttattgagtgcgatagtggcatcagttttatccagtgaaactaaaatgtcaccttgtcgaacgtagttcgtatctttatgattaacgacagtgacactacctgagacttgtgcagaaattggatctgcattccccgtgacataggcgtcatctgtactaatcatgtcttctaattccattgaccaataggcataggcacctgaaaacgcaataaataaaactaccgccaataaagaaaagtattttcttctgttagaatgttttttatttgaattaatctgttccactattatctctcatttctcatagatgaaatttatgaattgaatgaaaagagcattcattcttcatatcaaacacagtgcatgtgttgcacattatcccaggaacgttggaggcctaatttaaatgaggtgcaaaaaaaacaacagaggactaaaccgtggcttttgcaatacaattcttacgcctgtaggattagtaagaagacttatagtgccaacttgaaactataaatcatcggtacaatccctgattttattgttgacatttcatttatgccgactatttatatggtatacttgtcgaattatcttaaaggaagctcagattttcttatttttattgagaaaatgagatgacgccttatgtctgtattactacagggagaagggagatgcttcattgcaaagggaataatctatgaacgcaataattattgatgaccatcctcttgctatcgcagcaattcgtaatttattgatcaaaaacgatattgaaatcttagcagagttgactgaaggcggaagtgccgttcagcgggtggaaacacttaagcctgatatcgtcatcattgatgtcgatatccccggagttaacggtatccaggtgttagaaacgctgaggaagcgccaatatagcggaattattattatcgtctccgctaaaaatgaccatttttacgggaaacattgtgctgatgctggcgctaatggtttcgtgagtaaaaaagaaggcatgaacaatatcattgcggctattgaagctgcaaaaaatggctactgctatttccccttctctctcaaccggtttgttggaagtttaacgtccgaccagcaaaaactcgactccttatcgaaacaagaaattagtgtcatgcggtatattcttgatggcaaggataataatgacattgctgaaaaaatgttcatcagcaacaaaactgtcagcacttataaaagtcgcctgatggaaaaattagaatgtaaatcactgatggatctttacacattcgcacaacgtaacaaaatcggctaaccacatgaagtttttaccctatatttttcttctctgttgtggtctttggtcgaccataagtttcgcagacgaagattacatcgaatatcgtggcatcagtagtaacaaccgtgtcacacttgatccactacgtctgagcaacaaggaattacgttggttagcgagcaaaaaaaatcttgtgattgcagtacataagtcccaaacggctacgttgttgcataccgattcgcagcaacgggttcgtggtattaatgctgattatttaaatcttttaaaaagagcgttaaatatcaaattaacactccgggaatacgcagatcatcaaaaagcaatggacgcgcttgcagaaggtgaagtcgatatagtgttatcacatttagttacttcgccgcctcttaataatgacattgctgcaaccaaaccattgataattacctttccggcgctggtaaccacccttcacgactcaatgcgaccgcttacctcaccaaaaccagtaaatattgctcgggtagcaaattaccccccagacgaggtaattcatcaatcatttccaaaagcaacaattatctcttttacaaatttatatcaggcattagcatccgtctcagctgggcacaatgattactttattggtagtaacatcattaccagcagtatgatttcccgctatttcactcactccttaaatgtagtgaaatattataactcgccgcgtcaatataattttttcttgaccagaaaagaatctgtcattcttaatgaagtactcaatagatttgttgatgctttaacaaatgaagttcgctatgaagtatcacaaaattggcttgatacaggaaacctggcctttctgaacaaaccattagaactcactgaacatgaaaaacagtggattaagcagcatcccaatttaaaggtgctggaaaatccttactcgcccccctattctatgacggatgaaaatggctcggttcggggcgttatgggggacattcttaatattattaccttgcaaacaggtttaaatttttctccgatcaccgtttcacacaatatccatgctggaacacagcttagccccggaggatgggatataatacctggcgctatttatagtgaagatcgagaaaataatgttttatttgctgaagccttcataacaacgccttacgtttttgtcatgcaaaaagcgcctgacagtgaacaaacattaaaaaaaggaatgaaagttgccattccatattattatgagctgcattcgcaattaaaagagatgtatccggaggttgaatggatacaggtcgataatgccagcgctgcatttcacaaggttaaggaaggtgaacttgatgctctggtcgcgacacagctaaattcgcgttacatgatcgatcattactatcctaatgaactttatcattttcttattcctggcgttccgaatgcatcgctttcgttcgcttttcctcgcggagaaccggaacttaaggatattattaataaagcactgaatgcaattcccccaagcgaagttctgcgcctgacggaaaaatggattaaaatgcccaatgtgaccattgacacatgggacctatatagcgagcaattttatattgttacgacattatccgttttattagttggcagtagccttttatggggattctacctgttacgctcagttcgtcgtcgtaaagtcattcagggtgatttagaaaaccaaatatcattccgaaaagcactctcggattccttaccgaatccaacttatgttgtaaactggcaaggtaatgtcattagtcataatagtgcttttgaacattatttcactgcggattactacaaaaatgcaatgttaccattagaaaacagtgactcaccctttaaagatgttttttctaatgcgcatgaagtcacagcagaaacgaaagaaaatcgaacaatatacacacaggtatttgaaattgataatggcatcgagaaaagatgcattaatcactggcatacattatgcaatcttcctgcaagtgacaatgcagtatatatttgtggttggcaagatattactgaaacgcgtgatctaattaatgcactcgaggtagaaaaaaataaagcgataaaggctaccgtagcaaaaagtcagtttctggcaacgatgagtcacgaaataagaacaccaataagctctattatgggcttcctggaacttctgtcgggttctggtcttagcaaggagcaacgggtggaggcgatttcacttgcctacgccaccggacaatcactcctcggcttaattggtgaaatccttgatgtcgacaaaattgaatcgggtaactatcaacttcaaccacaatgggtcgatatccctactttagtccagaacacttgtcactctttcggtgcgattgctgcaagcaaatcgatcgcattaagttgcagcagtacgtttcctgaacattacctggttaagatcgaccctcaggcgtttaagcaggtcttatcaaatttactgagtaatgctctcaaatttaccaccgagggggcagtaaaaattacgacctccctgggtcacattgatgacaaccacgctgttatcaaaatgacgattatggattctggaagtggattatcgcaggaagaacaacaacaactgtttaaacgctacagccaaacaagtgcaggtcgtcagcaaacaggttctggtttaggcttaatgatctgcaaagaattaattaaaaatatgcagggcgatttgtcattagaaagtcatccaggcataggaacaacatttacgatcacaatcccggtagaaattagccagcaagtggcgactgtcgaggcaaaagcagaacaacccatcacactacctgaaaagttgagcatattaatcgcggatgatcatccgaccaacaggctattactcaaacgccagctaaatctattaggatatgatgttgatgaagccactgatggtgtgcaagcgctacacaaagtcagtatgcaacattatgatctgcttattactgacgttaatatgccgaatatggatggttttgagttgactcgcaaactccgtgagcaaaattcttccttacccatctgggggcttacagccaacgcacaggctaacgaacgtgaaaaagggttaagttgcggcatgaacttatgtttgttcaaaccgttgaccctggatgtactgaaaacacatttaagtcagttacaccaagttgcgcatattgcacctcagtatcgccaccttgatatcgaagccctgaaaaataatacggcgaacgatctacaactgatgcaggagattctcatgactttccagcatgaaacgcataaagatctacccgctgcgtttcaagcactagaagctggcgataacagaactttccatcagtgtattcatcgcatccacggtgcggctaacatcctgaatttgcaaaagttgattaatattagccatcagttagaaataacacctgtttcagatgacagtaagcctgaaattcttcagttgctgaactctgtaaaagaacacattgcagagctggaccaggagattgctgttttctgtcagaaaaatgactaaatagcggctcccacaatgttcaaatgtgggagctatttaccagcacatcttacatttatgatgagaactcctggcgaatttgttccccatgctggtcgagcgttgccgctcccggcataacatgcgggtccgcgcagccgctgatttttatcggattacccggcatcattattcccccggcttcaatcaacatatttctcgcctgagtttgtggcaatttaatggcctcagccacacttaataacggcgcgacgggtacaccaacttcatgtattctggctaaccaaacttcagctgcctgcgtttttaacgtccgctcaatatattgtttaagaatagcctggttttgtacgcgtaaaatattgctgctaaatcggggatcattaaccagttccgtaagctccagtgcctggcataacgcagaaaaaagcttgtcattaccacaacaaatcgtaatcggcttatcctgagtattgaaaacatcaaaaggtgccatgtagggatggcgatttcccagacgttgtggtgacttcccagttgcgatatatgccatcagaccatgctccagaaaactcagcgtggcatcaaacatcgctatatcgacatgcgcccctctctggctcttttcgcggccataaagtgcactcactattccgctgaataaatagacaccgccgcatagatccgcaagagatgtaccaacgcgcactggcggagcatcaggatatcctgtttccatcattatcccgctcattgcctgaatgatggtatcgtaggcaggagcatcttttagcggaccggtatgtccgaaacctgacgatgaagcatatatgaggcgcgggttgatttcttgaagcgtttcccatgaaaaccccagtttttccattgtacctgggcgaaaattctcagctaatacatcagcttgtttgagcatatttataaatatacttttatcgtgatcattctttaaatcaagaaccacactctctttgccatgattaataaaactgtaatagagtgactgtccatccacatagggaccaaatgtgcgggtatcatcaccatgacccggcggctcaactttaattacccttgcgcccatattacaaagaagttgagttccgaaaggtccattaaggacatgtgtcatatcgataactaataagccttcaaacggccctttgctttcattatttgtcatttgcttatgccttgaaaaaagccgaaggtgaaaagacacttcggcatttatgtaaaatcaataacatgattaattatgaaaccagtcgactgacataaatccacaagggagccgtgacgacaaagcccagtacgctcacagccaatgacgctgtaccagtacgggtgtagacattaaaccggctggcaataatgattccggagaatgccggcggtaatgcgcctgccagtaccatcatctgcagatgttcgctgttcaaatgacatgccataccaacgagaagcagtgccagtggcatcagaatcagcttcaggaaggtgttataagcaatttcggcactgaactcgaatttatgtgcagccagagtcaaccccgcagcgaataccgctacccctgagttagccttcgcaatcagattaaaggttgggtcccatgctgccggaatttttaccccaaccaacaccaggatcgttgccagaacaggtgcccatactactggctcctttgccgcagaaattaatgcgctcagattactattcttcttaccatccgctcctgaagaaggattcagcaaatacagaccaataggaatagtaattgcgttaacaataatagaaataattgctaccactaaacctgttgatacggaatcaccataaataggatcgagaactgcaaaccccaggaatccaatggtaggtgaacctgcaattaatgcacatacagctgcttctgcatgggtacgtttaaaaaatttgtagcaaccgaaccaggagaaaaagaaacatccgacaataaccacaagtgatacaagggtcagacgagtgtccgcaaaaatcatttccctgtttgcccgagtaatagatacaaatagagccgcaggaagcgcgtagtttaataccagtttattaaatgcccgagcttgatcttctgaaaatgtttctcgtctgccgctaaaataacccaacagcatgattacgataataggcaataaatcgccaataaaaaatgttagcataatagtatttccgataagggtcccctcaccatcgcataatgagttggcaagaggagacgatgtcagtatttaattaccagcgacttgttttgggttaagtttggtaatatggccactttcagttcctgctgcagggtcgatgaccacattaataatggtcggtttgcgcgactgaataccggtggttaaagcatgacgaagttcatctgtcgtggtgacgttatagccaacgccacgaaacgcatccattaatttgtcataccttgcatggtgcaacagatccgttggtgatggtgcaccagcgccactgagatcaacaccgtctcctctgtagatgccgccattattaaaaataacgatcgtcaccggcaggttatatcgacaaatcgtttcaatttccatcccactgaaaccaaaagcactatcaccttcaatggcgacaaccggagaaccagaagtcacgctagcaccgatggcatagcccataccgatgcccatgacaccccaggtaccacaatccagacgacgacgtggtttatacatatcaataatatttcgtgcattatccagggtatttgcaccttcattaactaaataaatatcctggttctcgcgcaatacgtcgcgcacagcacttaatgcattaaagtaatttaatggttgagtatctgtacttaatttttcatgcattttttgtgcattttgctgcttgtggatatttaaaatatcgcgccataccagtggagtcgtaaatgtgttttgtttcagttctgccagcataccttgcatactggatgcaatatcaccaacgactggcacagcaatggggcggttgctgtcaatttcctgcggttcaatatccagttgaataaactgtgtatctgccgcccatccttttttaccgtgtgccaataaccaattcagtcgtgcaccaacaagcatgacaacgtcagcatttgccagggcaaacgaacgcgcagctgccgcagaaagtggatgcgtatcttcaaggatccctttcgccatagacattggcaggaatggaatctgagcactttcaataaattcacgaagctgttcatcagcttgtgaatacgccgcgcctttgccaaggataattaatggccgttcagcttttgctaaaagcgaaattgcgctagtgactgacttcgggcatggcaataatgctggcgacggattttcaactttaacaatcgtggttaacgcttcgtctttttccatcgtcgcggccaggacatttgctggcaaatcaagataaactccgccagggcgacccgatacagagacccggatagcgcgtgccaatgcaatgccaagatcctgcggctgattaacgcgaaatgctgctttggcatacggttttgccgcattcatttggtccagctcttcataatcaccttgctgtaggtcgacgatcgcgcggtcgctggagccgctaatcatgatcatcggaaaaccatttaccgttgcgttggccaatgcggtcaaaccattgaggaatcctggcgcagaaactgtcaggcagatccccggtttttgggtaagaaaaccgcttgccgcagcggcatagcctgccgactgctcatgacgaaaaccaatataacgaatgccttccgcctgggcatggcgtgccatatccgtcacaggaatacctacaacaccataaatagtgtcaatattattctgttttaatgcttcaacgatgatatgcataccatctgtcatttgaagttgatctgacatgattaataacctcgaaatttttataaattgggagccagaagcccccgttaatatcagatggcgtggttttgcttcattgcagcaatttcatcgtcgctataacccagctcctgcaatacagcagcggtatgttcacctaatagcggcgcagctttaatatccggcgtaaaggcagagaatttcattggacaaccaacggtcagatattttccacgcaacggttgttccacttcaacaacactgccactttggcgcaaagagggatcaagtgaaatttctttcatacttaaaaccggtgcacaaggaatatcaaactgagtcaaataggccaccgcttcatgtttatcaatagtgacagtgtatttttcgatttcagcaaaaatatcgaaaatatgtggctgtcgtgcatgggctgtactgtatgccggatcggtaatccattctggtttgccgatggctttacaggtgttttcccagttttgctcctgaatagtgaaataaatataggcgttaggatcggtttcccagcctttacatttcaggatccagccaggctgaccgccaccacctgcattaccaccgcggggaactgcatcaccaaatgtaccattcggatactgcgggtattcttccagataacccaatttatcgagacgctgctggtcacgtaatttcacgcggcaaaggttcaatacggcatcctgcattgacatggtgactcgttgcccacgccccgttttttcgcgatgcagcaaagcagcaagtaaaccgatcagcaaatgcattccggtgttgctgtcacccaacgctgcagcgcttaccagcggcggaccatcccaaaaacccgtagtggatgccgcgccacccgctgcctgagcaacgttttcataggcttttacattcacataaggcgaacactcatcaaaccctttgatcgaaccaaaaatcagacgtggattgatttcttgaatatgctcccaggtgaagcccatgtgatcaatggcccctggatgaaagttctcgactaagatatcagcttcgcggatcagcttttccattacctctttgccttccgctgttttggtatttaactcaatagaacgtttgttactgttaagcatggtgaagtaaagcgcatcgatatcaggaatatctcgcagctggtgacgcgttacgtcaccaacgccgggacgttcaattttaataacgtcagcgccaaaccaggccagcatttgagtacaagatgggccagattgcacaccggtgaaatcgagaactttaattccttgaagtggagttgacatagcaatacctattagttaattaaatatgtgttaatttagcgtttatttaaggcgtaatatcttctataaataacccgcaaaatatcgtcgtagctgcactcgatatttttaaaatcctgtatcaagtgctgaaaatcatttcatcgccacttccaattcctttctgcatggtaagtagtgaggacgaaaagaagaatatgataaatattgattcgtggtaatcagagagagtcgcgacatttgtgatgttattcttacaactgtaagaagcgccggtgatttacaagcaagggtatgattacgctttttaaagcgtaccataaaacataacataataaatgatttgtgatgacacgggattattgcggtttactttgaggaatataaaatgcgagtttatagcaccgcgagcgccaaataattttatgaccacaacctgtcgtattgtggtcataaaaaattgtcggctggagggagttaaatcctttacctcaatatactgcctgtcagcattagttcacaaacagtgcttcgctatcgacgatgattccatcttccgcacctttaagcgccaggtttgcctcgtagtattgctttttatcaagcagtttctgcgcatcagcaagtgcattacgagtctgtttaagtggcatcagatattggttttccattacgccaacaccggccaggcgaagctcttccattgcgccctttttatcccctttcgccattttttcattggcaatttttatcgcggcttctttttcgggagttgctacataactctcagaaattccgacagatgcattaatgacaatatattggtcatcattgagattggtctttttacctggcttagcgaactttgcccattcggtactgtcatctgacagcaaagcggaagcttcattggtcagttcttttgccttttctggatcgccatgaaacagagccaggcgcgctacctgcacgtcacgcatcgcatataaaccttgttcagagatacgctctgctgccgctgccgttttctgggtttgctgaacttgctgagtttgctgttgtgccgctaccggagcattatcagcagcccatacagttgaagatgccagaattgctgtgaccatcgtggccataattaaacgtttcatacttacctcattctttaacagttttagaaaacgccgccatcatattgggtgagcatgaaatgagaaatcagagagcaacggtcattttgaaagggttatcttacagttgtagttattatcgcaagaagtattttagtcttacaattgtaggaatatgcttcctgtcgcagagaactattcttatataccacaaagagatgtcatttattatatcgatgtaaatactgattaattaaatgtaaatacagccataacatcgtaggttctcagtgaaccattttcaggataactttctatgaaagtaaacttaatacttttcagcttatttttattggtctctattatggcatgcaatgtttttgcattttccatttcgggtggtggaagtgagaggagctataaagagactgaaaaaacatcagcgatgacgaccacacactctacaaaacttcagccatcacaggcgattttgtttaagatgagagaagatgcgccaccattaaacctcacagaagaaatgccgcccccttttccgacaaaggcgaattatcttattcatcctgtgcgatagcgtctttcacatggcaggtgaacaatcatgtctgatgctgatgtgaacacctgcccaaatgagccatcctgacccactaccgcctgccataccccaccataaagcgaatcatcaagccacaagccggggcaagaaacataaatatccccgtcactagttcattaccgccagttaaccacatggtgaagtaataaatgagtgcagcgaggatcaccatgccgaagaaagaagagaccgccgataccacgttcagtacctgaccgatgtagccgcttacgcagacaatacacagggcgagaaacatccataaattaatcatagctcaacctcctgccgcgctaaaaaacctgtaacttcagtcactttaatagtaagacaatccttaacctctggcaatttttgctaagcatcaatgaaaacagcatgttaaatgcaagactgttgtgtacggaaaaatatttactttgcacgattaataatcagtagctgaaagcagtcagcgagtgataaagtacagataccgcattcatgctcctcgtggttatgtcctgactagtctttacactctttacaggaaccattgtcgtacatgatggcccaaccaattgagtgtaccgctgtcgacatggaatcttctgcgatacaacaattcgtatctacagaaggtaactatgtttccacaatgcaaattttcccgcgagtttctacatcctcgctactggctcacatggtttgggcttggtgtactctggctttgggtacagcttccttatcctgttctctgctttctcggcacgcgtattggcgcaatggcgcgaccattcctgaaacgtcgtgaatctatcgcccgtaaaaacctggaactttgtttcccgcagcattctgcggaagaacgcgagaagatgattgccgaaaactttcgttcactcggcatggcgctggtagaaaccggcatggcatggttctggcccgacagtcgcgtacgtaaatggtttgatgttgaagggttggataaccttaaacgcgcacaaatgcaaaatcgcggcgtaatggttgtcggcgtccattttatgtcgctggaactgggcggccgcgtgatgggactgtgccaaccaatgatggctacctatcgtccacataataatcagctgatggaatgggtgcagacccgtgggcgcatgcgctctaacaaagcgatgatcggcagaaataatctgcgcggcattgtcggtgcactgaagaaaggtgaagcggtatggtttgctcccgatcaggattatggtcgtaaaggcagctccttcgcgccgttctttgcggtggaaaatgtcgccacaaccaatggcacctatgttctctcccgtctctctggcgcagccatgttgaccgtaacgatggtaagaaaagcggattacagcggatatcgtttgttcatcaccccagagatggaaggctacccgacagatgaaaatcaagccgctgcctatatgaacaagattatcgagaaagagatcatgcgcgcaccggagcagtacctctggatccaccgtcgctttaaaacgcgcccggtgggagaatcgtcgttgtacatttaacaaactgctcttactctttccctcctcaaatcggccataataacctcatggtttttatggcttttttcttaaggttttttccttcgctgaatatctaattattaccgtcagaaattaaactgtcgccgatatgagacacttgtaagttactaaaagtaaataagaaaatgcctcttgtctcgtttcagttttaggcgtacattagcgccgtctcgagcagtttagctcagaattctggggtgatgcccacggtaaaatacagggcttttaaggtcgctttgcccggtgtcaactcactgtatcaggtgtaatgaagtcattcaggcgtaacagtaattacgcggagagatgtaaagtgaaatatttctttatgggcatttcttttatggtcatcgtttgggccggtacttttgccctgatgatctaaaagcaaactgtgcaatgaaaaacaggagccatcaggctcctgtttgcatttctgacgacggtgtttattccgcgttttcgtgaatatgtttgctgctggcgggtagtaaaccgtcggcacggaacatcgctttaatccctctgatggcctgacgaatacggtcgcggttttcaatcagtgcaaagcgaacatgcgtatcaccatagtcgccaaagccaatccccggcgagacacaaaccttcgcttcgttaaggagcttcttggcaaattccagcgatcccatggccgcatatggttccgggattttcgcccagacatacatcgaagccttcggcatttcaaccatccagcccgcttcatgcagccctttaaccaatacatcacggcggcgtttgtactgttcggcaatgtcgcgcacgcactgttgatcgccctccagcgccgcaatcgccgccacctgcaacggcgtaaaggtgccgtaatcgtgatagcttttaatacgagccagggcgctgaccagcgttttgttgccaaccataaagccgatacgccagcccgccatgttgtagcttttcgacagcgtaaagaactcgactgccacatcgcgtgcacccggtacctgcataattgacggcgctttccagccatcgtagacgatatcggcataggccaggtcatggaccaccagcacatcgtagcgtttcgccagcgccactactttttcgaagaactccagttccacgcattgcgcggttgggtttgacgggaagccgaggatcatcatcttcggtttcggataactttcacgaatggctcgctccagttcgttgaagaaatcgacaccttccaccagcggcactgagcgtacctgcgccccggcaatcaccgcgccataaatatggatcgggtaacttggattcggcaccagcaccgtgtcaccatgatccagcgtcgccagcatcagatgcgccaggccctctttcgaaccaatagtgacgatggcttctgattccgggtcgatttcaacgtcgtagcgatcctgataccagcgggaaatggcgcgacgtaaccgcggaatgccgcgtgaagtggagtaaccatgcgtgtccgggcgctgggccacagtacataatttttcgacgatatgcggcggagtcgcaccgtccgggttacccatgctgaaatcgataatatcttcgccgcgccgacgcgcagccattttcagttcagcggtgatgttaaaaacgtagggcgggagacgatcaatgcgcgtaaagcgacgttcagggcgagtgtcagccataatttcctcagattaacgttagcgcccggaccgtccgagcgacgctgccacgatggtggctgttttgaaaatagcctgattaatttctgtctgtccagcgttttagaacattttattaatgacgttaaatgaggaactctgctttaaaaacaggaaatttatctgcgctaacaagaaaattaccactcattttattaacataataatttcaataaatttactaaccagaagtgcattatcaagagatgcattgctaatacaccatttatctatcaatccccttttaaaattgtggtttttcctcaaaaacggcctgctggtcatcagccttcaggttacctatcatagaggtttaatccttattcagagtcacccgtgcacgaaatattcaacatgctgctggcggtcttcgatcgggcagcgttaatgcttatctgcctgttctttctcatccgtatccgcctgtttcgcgaactgttgcacaagtcggcgcactccccaaaagaattgctcgccgttaccgccattttctcgctgttcgccctgttcagcacctggtccggcgttcccgtagaaggctcgctggtgaacgtacgtattatcgcggtgatgtccggcgggattctgtttggcccgtgggtaggcatcattaccggcgtgattgcgggtattcaccggtatttaattgatatcggcggcgtgacggcgatcccctgctttatcaccagcattctggcgggttgtatatcgggctggatcaacctgaaaatccccaaagcacagcgctggcgcgtcggtattctcggcggcatgttgtgtgagacgttgaccatgattctggtaattgtctgggcaccaactaccgcgttggggatcgatatcgtctctaaaatcggcattccaatgatcctcggtagcgtctgtatcggctttattgtgcttctggtgcaaagcgttgagggcgaaaaagaggccagcgccgcgcggcaggccaagctggcgctggatatcgccaacaaaacgctaccgctgtttcgccatgtcaatagcgagtcattacgcaaggtctgcgaaattatccgcgatgacattcacgccgatgcggtggcgattactaataccgatcatgtgctggcctatgttggcgtgggtgaacataactatcagaatggcgatgacttcattagcccgactacccgtcaggcgatgaattacggaaaaatcatcattaaaaacaatgatgaagcccaccgcacaccagagattcattccatgctggtgatcccattgtgggagaaaggggtcgtgaccggaacgctgaaaatttactactgccacgcgcatcagatcacctcgtcattacaggaaatggcggtcggtctgtcgcaaatcatctccacgcaactggaggtttcacgcgccgagcagctacgtgaaatggcaaataaggcagagcttcgcgccctgcaaagcaaaattaatccccattttctgtttaacgctctgaacgctatttcatcgtcaatccgtctgaatccggataccgctcgccagttgatctttaatctgtcgcgttatctgcgctataacattgaattaaaagacgatgagcaaatcgatatcaaaaaagagctgtatcaaattaaagactatattgccattgagcaggcccgctttggtgacaagctgacggttatctatgatattgatgaagaggtgaattgctgcattcccagcctgctgatccagccgttggtggagaacgccattgtccacggtattcagccttgcaaaggtaaaggcgttgtcaccatcagcgttgcagagtgcggaaatcgggtacgcattgcggtgcgagataccgggcacggcatcgatccaaaggtgattgagcgggtcgaagcgaatgaaatgccgggcaataaaattggcctgctgaatgtccatcatcgcgtgaagttattgtatggcgaggggctgcatatccgccgcctggagccggggacggaaattgcgttttacattcctaaccaacgcaccccagtcgcctcacaggctacgttattgctttgagccggagtgatattgtgaaagtcatcattgttgaagacgaattcctggcacaacaggaactgagctggctaattaaagagcacagccagatggagattgtcggcacctttgacgacggtctggacgtgttgaagtttttgcagcataaccgcgtcgacgccatttttctggatatcaatattccgtcgctggatggcgtgttgctggcgcaaaacatcagccagttcgcccataaaccgtttattgtgttcatcaccgcgtggaaagaacatgcggtagaagcgtttgaactggaggcgtttgactacattctcaaaccgtatcaggagtcacgtattaccgggatgctgcaaaaactggaagcggcctggcaacaacagcagaccagcagtacgcctgccgcgacggtaacgcgtgagaatgacaccattaatctggtgaaagatgagcgaataatcgtcacgccaattaacgatatctattacgccgaagcgcacgagaaaatgacctttgtctatacgcggcgtgaatcctacgtaatgccgatgaacattaccgaattttgcagcaaactgccgccgtcgcattttttccgctgccatcgctcattttgtgtcaatctgaacaaaatacgcgaaatcgaaccgtggtttaataacacctacattctgcgactgaaagatctggattttgaagtgccggtcagccgcagcaaagtgaaagaatttcgccagttaatgcatctttaatcgggaactttcatgaaagcaccaggcttgcccgccgatcaacaatttttcgccgatctgttcagcggcctggtgcttaacccgcaactactggggcgcgtctggtttgccagccagcctgcctcgttgccggtgggcagtttatgtattgattttccccgtctggatatcgtgctgcgcggcgaatacggcaatctgctggaagcaaagcagcaacgtttggtggaaggagaaatgctgtttattccggcgcgcgcggctaatttaccggtcaacaacaaaccggtgatgctgttaagcctggtgttcgctccgacctggcttgggttatcgttttacgatagccgcaccacgtcgttgttgcatcctgctcgccagatccagcttcccagcctgcaacgcggtgaaggtgaagcgatgcttaccgccctcacccatcttagccgttcgccgctggagcaaaatatcattcagccgctggtgttaagtttgctgcatctttgccgtagcgtggtgaatatgccgccgggcaattcgcagccgcgcggcgattttctctatcacagcatttgtaactgggttcaggataattatgcccagccgctcacccgcgagagcgtggcgcagttttttaatatcacgcccaatcatctgtcaaaactgtttgctcagcatggaacgatgcgttttatcgagtatgtgcgttgggtgcgaatggcgaaggcgaggatgattttgcagaaatatcatctgtcaattcatgaagtggcacagcgttgcggttttccggatagcgactatttttgtcgcgttttccggcgtcagtttggtctgacgccgggagagtacagcgcccgttttcagggctaacgtcagaaggttaattctgtttccagcagcgtcaggatactttgtgcatcttgcgcggcaaacaacgactggcggaagtttttattcaccagtttacgcgccagctgcgagaagactttcacatgattcatcccttcgttagcacccagcgtcagcatgatcaccagttcgacttcgcccatttctgactgccagccaatcggtttcgccagccgggcaatgctgatactggaatgacggatccactgagatttggtgtgcgggatcgctacgccaaaaccaacgccggtggtaacaatctcttcccgctgccagacatcttcttccagctcaaacggatgttcagtgcgcccgttaacgccgaggttgccgcacaggaactggatcgcctgctctttattgctaaaatcctgatcaacaaagatattctccagcgccagcagtgggcgaacgtcttcttccggcgtaaaggcggtgagtaacgcttcaatttcctgcgcactgcggcattcacatgcctgacgcgccagttcccgacacgcctcgctatccagttgacgaagctggcttttcaccgccggaatacgcgggctactcatactcagctcatccaggcccagcccaagcagtagcggcagataacggctttcaccgcccagttcaccgcaaatgcctacccatttgccccgctgatgcgcagtggtaactatttgctgcaacatgcgcaggaacgatggcgtaatcgggttatatagcggcgatacgcgcgggttattacgatcgaccgcatacagatactgggtcatatcgttggagccgatactgaagaaatcgacctcatcgcagaagtggtcgatgatgtagcacaccgacggaacttccaccatgatcccaagcgtaatcgtctctgcatgacgcaggccatcgcgcttaagctcaacgatcgctttttggatctcgcctttcacccataagatctgatcgaggctgtgaaccatcgggatcatcaactgggcgttgccgaaactggcggcgcgcaaaatggcccgcagttgagtgcggaacaggccagcaaattccgggtaaatacgtaccgcgcgatagccgaggaacgggttctcttcctggggaatattcagataaggaatgcttttatcgccgccgatgtccatcgtgcggaagataatcggcttgtcgcccgccgccagtagcacctgctggtaggcttcaaattgctcctgctcgtccggcgcgctgtcgcgatccatatagagcatttcggtacggaacagcccgacaccttccgcgccgttggcaaacgcgcctggcgcttccagagcggtgccgatattcgccgcaatatcaatacgcttgttatcacgggaataggccagctgcgcggcagcctgcgcctgttgtttttggcgtttatccgccagcgtctgcgcgacctgataataaccgctcaccgcgtcattcgggttaatcgccagcacgccgcactgggcgtcaagcactgcaggttgcccggcataacgggcaatcgcatccagcggcaagccactcagtaccgggatcgccgaggcacgggccagaatcagtgtatgcgaggtgcgcccggttttctccagaatcatgcccgcaagatttttcaaatcaaggctcaaaaactggcttggggttaaatcttcagccaccagaatggtcggtttttcaagcaccagcttgttgcgcggcttcagttccggccaggtgatatgcagcaactgttcgctgatatcgcgaatgtcgctaacacgttcgcgcagataatcgctggcagaggcagaaagtttggcgcaaacctgctccatattgctgatgatcgccgcccccagcccctgatgctgttctgtcatcaggcgacggatattgcctgcaaattcatcatcctgaatcagcgacaaatgggcgctgaggatagttttgctttcgccgtcacgctcacgcaattgctggttcagttgctcggcaagcgttgccaggctgtgctccagccgggtggaatcttgcgcactggcggggattgcccgataactgtcgaggctgtcgctttgtaacagggtcagcgtacccacgccgacgccgcttgccagcacattgccgtacagtaaatccgggttaaggcggcttaatgaacgcggcagcggatgcgccgtcagttctgcctgcgtaggctgaacgctgtcgctgtcgataaagcgcacctggatgtactcttccagcacgcgccgcgcctgctcttcatcgctgccgctaatgttcaggctgcaactgtcattaaatagggtgccggtgccaatcagcgccagcgagcttttcgcatctgcctttgcgttctggcgatggttaataaaagtgatttcgctttgccactggctgcactgttctttaagttcccacgccggacgagcatgtagaccgttaggcaaaggacagagaaattgaatcgttaacataaccgctccgggttaatcaggagatcatctgaaatccgtcagttgaacaaccgtctcacgcgtaagacgttgaataagggcagataaaagttgctgcatctgcaaaatgtcgcggcaatcggcaatcgatgcggcgcaatgtccatggcgggttgctggccccatcaccactgtgggcacgccggtgccggttaagtgcaccgccccgccgtccgtgccgccgttgctgaacatatctgcctgcaacggcacgccaatttctgccgccacggtttcgacccaggcggtaagttttggcggcgcaatcagcgacttgtcgcttaacaccagcatcggcccgttaccaatctggcgatggttagccgcgccataatcaaagtttttcgcccagcaggcggtatcaagcacaatggcgacgtccggcgacaccgcgcgggtggcagtttgcccgccgcgtaatcccacctcttcgctggaacttgccaccagccacacttccgcaggtagttcggcgtcgtgcagttcgcgcagtaacgtcaccagcagatagcaaccgaggcggtcatcaaaggctttccccatcactcgctggtgagggagaacctgaaaagtggtatcaaacgtgacgcgatcgccgggacgaattcccgcctgcatcacttcgtcataggagcgcgcaccaatgtccacgcgcatggcgctgacgtcattcccctgccggtcgccgtcaagcaggcctggaattttgcactcttcacgggtggtgatgcgcaccggctgcagctggcgggcagccatgcgtacgttgccaaccggcagcacatcaatcgccccttcgcgggagatgctgcgcaccataaatcccacttcgtccatatgcgcacagatcatcaccttcggacctgtcgattcattcaggcggatcagcaccgatcccagaccatcaaatcgcacttctttttgcaggcgatccgcttcttccagcaggatctgccgcacttcctgttccgaggaggcgatcgcatctgcctcgctcaacgcttttaatagcgataaatccattatgcctctcccgtgagcaacactgttttcggcatggcgtagagcacttctgcgccttgcggggtaaccagcacaacatcttcgatgcgcacgcccccttgccctggcaaataaatccccggctccacggtcagtaacatgcctggctgtagcgtcgtggtgtcccgcggtgaaaaacgcggatcttcatgaacttcaatgccgatagcgtgaccggtgttatgaccgaaatagtcgccataacctgcttctgtaatgacccggcgcgcggcatcgtcaacctgctggcagcgcacgccggggcgaatcgcggagattgctgcgagctgtgcctgcaggacaatttgatagacgttaaacagcaggtgagattcggcgctcaccccttcgccattcaccagcaaggtgcgcgtcatatcagagcagtagccctgatacagcgcaccgaaatcgagagtgacaaactcgcccgctgcaacaatcttgtcgctggctttgccgtgcggcagcgccccacgccagccactggcgacaatggtgtcaaaagaggctttttctgcgccctgctggcgcataaaccactccagttcagcggctatctcgcgctcgctcatccccgcctgaataaagcggcgaatatgctctgcaccgcgatcagcaatcccacaggcgaggcggattttctccacctcctctggcgttttgatttgccgcagcacatccggcgtggcgctaaccagtttcgcattgagttcagactgccagcggtgcgcggtttcccaactcacctgctggccctcaaaaccgagcgtttgcaactgttcatcggcaatgatttgattgacgatagtggtaagcgtgttcgtcgcgtcaagcaaatgcagctggtagccttgcgcacgggcttccacctcaacgtaatagcgcgaatccaccagaatgtgcgcactttcacggctaatcaccacataacctgatccggtggagatccccagatgcggctgtttgttctgccgtgaggagagaagcactgcatccagttgttgcgccttaagccagtcgcgcagcgaagcgagtaatgtcatctggattttccttcttacaggctatcgattaacaatttgcctttacggaacatcatcagacgcaggaacaccaccatcagcgcagttatgactgcccccagcgcgatccccgccatatagacgcccaggttagtgaccagcggccatgcccagatagcggactccgggaaccattgcactgcgcccagccagacagcggcggttgagccgacaatagcgccgaccatatacgacggaatggcggtgatggggctttccagcgcaaacggaatcgcaccctcactgatccccataaacgccaggaacatggcggtcttaccctgcggataaagttgagcgttgaacaggcgtttgccggttaaacgacggtcgataatggtcgccagccccagaccaatcggcggaataacgatagcgatagaacgagcggtgaccggtaatacgtggtcagtggtaaagctgaaggcaacaaaacctgcggctttgttgatcgggccaccaaggtcgattgctgtcgccgcggcgatccccattgcgtacatcagcgcgcccttctcacctgcggcagtcagcacagtacggataccgccgttgatccagccaccaaagggggtgatgacgtagtacatcgccagcatgacaaaaatggcggaaagaatcgggagcaaaaatgtggttttgaacgctaacaggaaatccggtaactggattttctggttcatccacttcacaaggtaaccggcaacgatagaaataatcagcgcaccaatgaaggtggacggcaccggcgaagaggtcgcccattgcatagtgctgggatcgaagttcagcagttgcgtcggctgggtagacatcaacccgccgataaaaccagccgggaacgccagtttgccaccgatagagttcgccacaaaagcagcaaacatcggaatggcaaaaccaaacaacacgccgccgaaggactgcgacagccaggcaaatttaagtaaggagaggtcgaaaccggagaatttcccgctattaagagcatccatgatgccgatctcagcaggaattttaagccagctataagcaatcagctggctgaaagcgaggatcacaccgcccataattaaggtcggcaccatgcgtgaaatccctgacatcacatgctgcgggagttcaccccagaagctggttttagaggcctgcggattcttaactgccgctgccgcaccggatgcgccaggcacaacggttgcactgcgttttttaatggccataacaattatccctgtcgaatattactgttgttcagaggcaatcatctcttcgatttctttgatgatgcccgcagcgtttttaattgcgtcctgcaaagtgatttcataaacgtcgcgtgattcgaaacgttcgttatcttccggggtaactgccacggagtggatgatgatggtcgcttcggcgatatcctgcgccgtcaggcgattctggataccgtccgcgccctgggtttcaattttcacttcataaccggcttctaccgccgcttcttccagcgcctgagcggccataaaggtgtgagccaggcccatcgggcaggcacataaggcaatcagtttcttactcatcgttaattcctcgttcagtgatagttgacgagtgaaattatgaacgtgcaaaacaaatcgccgttaccagacaaataatgcatttactggagaattaatcccgctgtacggaagtgtgacgcaggtcgaccttgtgaggggacacaaagaaaaattgaataaactgtatgatttaaaagattatcgggagagttacctcccgatataaaaggaaggatttacagaatgtgacctaaggtctggcgtaaatgtgcaccggaaccgagaaggcccggattgtcatggacgatgagatacaccggaatatcatggacatattctttaaagcgccctttatcttcaaatgcggcacggaaaccggaggctttgaagaactcaaggaagcgcggcacgataccgcccgcaataaacacgccgccaaatgtcccgagattgagcgccagattgccgccaaaacggcccataatgacgcaaaacagcgacaatgcgcggcggcaatcggtgcagctgtcagccagcgcgcgttcggtaatatcttttggcttgagattttctggcaggcggttgtcagctttcacaattgcgcgatacaaattcaccagcccagggccagaaagcacgcgctccgccgaaacatgaccaatttccgcacgcaatatttcgaggataatggcctcttcttcactattcggcgcaaaatcaacgtgaccgccttcgcctggcaagcttacccaacgcttatcgacatggaccagatgcgcaaccccaagccccgttccggcaccgtaaaccgcaataggcttaccttcgaccggttctgcgccaccaaactgaatcagatgctcttttttcagcatcgggatcgccatcgatacagcggtaaaatcgttaataatttccagatggctaaaaccgagattctttttcatttcggcaattgagaacgcccaggtatggttggtcatcgccacccagtcaccggtaattgggcaagcgatggcaatacagccgtctttcacctcgaccttatgttcttcaagataaacgcgaatgaccgcttcgaggctggggtaatcaagccctgaataggtcttagcctgcgagatttcaccactggcaatatcacacagagcaagacgtgcgttggtgccgcccacatcaccgactaatgcatactttgtcattcttcaactgctccgctaaagtcaaaataattctttctcacactgtaaatacctgggggcataacaacaacgccggaaaggcaggctccctgtaaatatcgatctgggtcacacaattactttatcgtttcagcaccaattgcagcgatgcctttttgcaagctgggcaaactaagtatctgaccccgcataaggaatagaacatgctccatccgcgagccagaaccatgttgttattatcgctccccgccgtggcaattgggattgcgtccagtcttattctgattgtggtgatgaaaatcgcctcggtattacagaatttgctctggcaacgactgccgggaactctggggatagcccaggattcacccctctggatcatcggtgtattaacgctaacgggtattgcggtggggttggttatccgtttcagccagggtcatgccggaccagaccccgcctgtgaaccgctgatcggcgcaccggttccgccctctgcgctacctggacttatcgtagcattaattctcggtcttgctggcggcgtcagcctggggccggaacatccgatcatgaccgtcaatatcgcccttgcggttgccattggcgctcgtctgttaccgcgcgtcaaccgaatggagtggactattttagcctctgccggaaccatcggcgcactgtttggcactcctgttgcggcggcgttgatattttcgcaaaccttaaatggcagtagtgaagttccgctatgggatcgtctctttgcgccgttaatggcggcagcagctggtgcacttactaccggattatttttccatcctcatttttcactgcccattgctcattacggacagatggaaatgaccgatattctcagcggtgcaattgtcgcggcgattgccatcgcagcagggatggtcgccgtatggtgcttaccacggttgcacgcgatgatgcatcaaatgaaaaatccggtgctcgtgctgggtattggcggatttattctcggtattctgggggttattggtggaccagtttcgctgtttaaagggctggatgagatgcagcagatggtggcaaatcaggctttcagcaccagcgattactttttgctggcggtaattaaacttgccgccctggtcgttgctgccgccagtggctttcgcggtgggcgaatcttcccggcagtgtttgtcggcgtggcattagggttgatgctgcatgagcacgttcccgccgtaccagcggcaataaccgtttcttgcgctattctcggcatcgtgctggtggtaacacgcgatggctggttaagtctttttatggcggcagtcgttgtacccaataccacattgctaccgctgctctgtatcgtcatgcttccggcatggctgttattagcaggtaagccgatgatgatggtcaatcgtccgaagcaacagccaccccacgataacgtttagcaaaaaatgctctcctttatgatttaagagttatggcgatgatacggggctttacctccccgtaatattgcgttaacaggccgctgacggcttcgagcgtgaaggagaataacaatgttcaggtcactgtttctggcggccgccctgatggcatttaccccgcttgcagcaaacgcaggtgaaatcaccctactgccatcaatcaaattacaaattggcgatcgcgatcattacggtaattactgggacggtggtcactggcgcgaccgtgactactggcatcgcaattatgagtggcgcaaaaaccgttggtggcgtcatgataatggctaccaccgtggctgggataagcgtaaagcgtatgagcgtggctatcgtgaaggctggcgcgatcgtgacgatcatcgcggaaaaggccggggtcatgggcaccgccattaaacgcgtccgccaatggagcacaatgcctgatgcgacgctagtgcgtcttatcaggcctacaaaccggctctttaacgcgtagggcggataaggcgtttacgccgcatccgccaatagtgccagatgcgacgctcattcaactacaatcccagcgccgtccccaccaacaaccagatattcagcgccacgaccagcaccacaatcacccagcctgtctgttttacgcgtttgctgttcaccagatcgcccatcaacttgctgtcactggtgaaaatcagcagtggaaccagcgccagagcgataccaaaacttaacagtacctgactcataaccagaatccgtgtcggatctaatcccatcagaatgacaataaatgacggcaacatggtgactgtacgacgcacccacagcgggatatgaaagcgaatgaagccctgcatcaccacctgccccgccagtgtccccaccaccgttgaagacagccccgcagcaaccaggcttaatccaaagaccgttgccgcagcgtggcttaacagcggttgcagcgtcagataagcctcatcaagatcggcaacaccagtatgaccggaaaagtggaacgccgccgcagctgtagccatcatcgccagattgacaaaaccggcaatagtcatggcgatagccacatcccatttggtggcggaataacgttgttgacgcgaaccgccatgtaaatgctgagtgagcgaggagtgcaaataaatcacatgcggcataatcgtcgcccctaacacgcctgctgccaggaagaccgcttccgaagtaggtaaactcgggatcaccattcctttacccagctgcgccaggttaggctgggagaaaatcaactcgacaatgtaagccgcggcaacaaacaacagtaacccgccaatcactttctccagcggtttttgcccgcgacgttgcagcattaaaatcaggaaagtcgcgatccccgtcagcaccgcgccctgcaacaacgaaacaccaagaatgagtttaaaaccgatcgccgcaccaataaattccgccaggtcggttgccatcgcaataatttctgcctgaacccaatagaaccacactacgggacgcggatagtgatcgcgaatctgctccgccagatttttaccggtggcaatccctagtttggcagagaggatctgaatcagcatcgccatcaggttggcccaaacgacaacccacagtagctgatagccgaagctagcacccgcctgaatattggtcgcaaagttaccgggatcgatataaccaatcgccgcaatgaacgcaggtcccattaatgcgagcctcatcttgcgcgccgcccgtccgctgctactctcaacgcgatagttcgtcatcttgtgcctctaaaacatagcctttgctatgtttcatgctatgccaaacgagaatgattatcaaattcatttaaatggattgtggtgatttctctgatagaccaggattatgactacgaaaagattgatgacttgaatgttatggttatgtttaatgttagcacatttacataactttcagcttccatacacaacatagcagaaatgtatgacagatcactatttttgaagcctgtcacaggacgtcattatagtgtgtgtcagatctcgttttccttaaccatgttacatagaatgtgcacggaaatttaacctgcctcatatttggagcaaatatggaccgcgtccttcattttgtactggcacttgccgttgttgcgattctcgcactgctggtaagcagcgaccgcaaaaaaattcgtatccgttatgttattcaactgcttgttatcgaagtgttactggcgtggttcttcctgaactccgacgttggtttaggcttcgtgaaaggcttctccgaaatgttcgaaaaactgctcggatttgccaacgaagggactaacttcgtctttggtagcatgaatgatcaaggcctggcattcttcttcctgaaagtgctgtgcccaatcgtctttatctctgcactgatcggtattctccagcacattcgcgtgttgccggtgatcatccgcgcaattggtttcctgctctccaaagtcaacggcatgggcaaactggaatcctttaacgccgtcagctccctgattctgggtcagtctgaaaactttattgcctataaagatatcctcggcaaaatctcccgtaatcgtatgtacaccatggctgccacggcaatgtccaccgtgtcgatgtccatcgttggtgcatacatgaccatgctggaaccgaaatacgtcgttgctgcgctggtactgaacatgttcagcacctttatcgtgctgtcgctgatcaatccttaccgtgttgatgccagtgaagaaaacatccagatgtccaacctgcacgaaggtcagagcttcttcgaaatgctgggtgaatacattctggcaggtttcaaagttgccattatcgttgccgcgatgctgattggctttatcgccctgatcgccgcgctgaacgcactgtttgccaccgttactggctggtttggctacagcatctccttccagggcatcctgggctacatcttctatccgattgcatgggtgatgggtgttccttccagtgaagcactgcaagtgggcagtatcatggcgaccaaactggtttccaacgagttcgttgcgatgatggatctgcagaaaattgcttccacgctctctccgcgtgctgaaggcatcatctctgtgttcctggtttccttcgctaacttctcttcaatcgggattatcgcaggtgcagttaaaggcctgaatgaagagcaaggtaacgtggtttctcgcttcggtctgaagctggtttacggctctaccctggtgagtgtgctgtctgcgtcaatcgcagcactggtgctgtaagaccatacataaaaaagccggggataattcccataagcgctaacttaagggttgtggtattacgcctgatatgatttaacgtgccgatgaattactctcacgataactggtcagcaattctggcccatattggtaagcccgaagaactggatacttcggcacgtaatgccggggctctaacccgccgccgcgaaattcgtgatgctgcaactctgctacgtctggggctggcttacggccccggggggatgtcattacgtgaagtcactgcatgggctcagctccatgacgttgcaacattatctgacgtggctctcctgaagcggctgcggaatgccgccgactggtttggcatacttgccgcacaaacacttgctgtacgcgccgcagttacgggttgtacaagcggaaagagattgcgtcttgtcgatggaacagcaatcagtgcgcccgggggcggcagcgctgaatggcgactacatatgggatatgatcctcatacctgtcagttcactgattttgagctaaccgacagcagagacgctgaacggctggaccgatttgcgcaaacggcagacgagatacgcattgctgaccggggattcggttcgcgtcccgaatgtatccgctcacttgcttttggagaagctgattatatcgtccgggttcactggcgaggattgcgctggttaactgcagaaggaatgcgctttgacatgatgggttttctgcgcgggctggattgcggtaagaacggtgaaaccactgtaatgataggcaattcaggtaataaaaaagccggagctccctttccggcacgtctcattgccgtatcacttcctcccgaaaaagcattaatcagtaaaacccgactgctcagcgagaatcgtcgaaaaggacgagtagttcaggcggaaacgctggaagcagcgggccatgtgctattgctaacatcattaccggaagatgaatattcagcagagcaagtggctgattgttaccgtctgcgatggcaaattgaactggcttttaagcggctcaaaagtttgctgcacctggatgctttgcgtgcaaaggaacctgaactcgcgaaagcgtggatatttgctaatctactcgccgcatttttaattgacgacataatccagccatcgctggatttcccccccagaagtgccggatccgaaaagaagaactaactcgttgtggagaataacaaaaatggtcatctggagcttacaggtggccattcgtgggacagtatccctgacagcctacaaaacgcaattgaagaacgcgaggcatcgtcttaacgaggcaccgaggcgtcgcattcttcagatggttcaacccttaagttagcgcttatgggataattccccggtttttttacgcctgttaatcagctaatggctgcgggcgaccaatcaaatacccttgcagatattgcaccccgagcttatgcaatagcgcctgctgctgttgcgtctcgacaaactccgcgaccacactcaatgacttcgctttcgccagatcggtaattgatctcacaatcatcgcatccagcgtgttcgtgacaatatctttcacaaagacgccatcaattttgatgatatcagcctgcaaacgctttaaccgttcgtagttggcatatccggtgccaaagtcatcaatcgcaatccggaaaccaaacttatgcagctgctcgatgttgtacatgctgctttctgcgttagaaaacgcctgctcctcggtgatctcaagaatgaccgcctgcggggagatgtgataacgcttaaacagacgaataatccgcccggcaatattcttttgcagcagcgtgagcggcattaaattgactgaaaagcgcggtccttttttgtcgcaagggtgtgttgccagccacttcaacaaggattccagcacttgcaaatcaaaacgcgcgctaaggttaaactgagcaataaggggcagaaacttatccggggtcataatgccgccgtcatatttcagtcgcgcgaggatctcatcataaccttcaccctctttgttgcgaattggctgggcgtagagcagcaaatcaccctgatctaacgccgtgcgaatggtattcagcaatagcacctgtttagtggtctgcccggaaaccatctcctctctgctatccagcgccagcacatgatgatgtgcgcaggattgctccgccagccagcttaactgccccaacaagggttgcagggtttcctgatttccatcaaaacgcccccaggcagcaccatagcccatatccagcccggtattgttccagtgaatttgccgactattcaggatgttaaccatatgctggagtcgcccttccgtttccggcccgctcagcactaacagcagttcactacccggcaattgatacaacttttcgttttcctgcatcaacggcagcagcgtacggcaaattgagcggatacagtgaacgcgcatcattaagccgtaatgacgactcataaactcaagattatcaatgcgcaggcagcaaaaactcttgcccgcctcttgctccggcgcttgttccaacgcacgaaagttgggtaggagcgttaacggatctgtcagcgcctgcaaatgccagcggcgattaagccattcactgcgatgataaatgcgcaccatatagagcaggcaaacgctaaaggaaatcagcaccgcaagaataaatgccagcgaatattcggtttccaccccttgcaaaaagttctggttgtaattcagaaggcaaagcgttgaaacagcccaggtgagatttaaaaacggatagcgaagcttaccgaccccgagggtaaagatgatgaagaaaacgggtaccaggtaaccggcaataaagtcgttttcataaggtgtgcacaacagaagtagcagcacgcttaacgctgccagccagcttaaggtaaatgcgcgtttctctttgcccaacgacggagcgatatccctgcgccacaatatctgcgcaaagtggggacttacaatcatgcgagtgagatagtagaaaagcatgttgtaaatcagcacagcggtgaaaaggcttagcaaatcaacgaccgtgaaaatggcatccgcatcgccgaaaaaggtggatatctttagcgggaaatcaaagaagctccccacaagatacatgctgcatttgatgccgatcggcgtcaccaaaccaagccagaacagacgttgccagacatatcggctggtcaatccataacgccaacgcgtccccagctgccagcgtaatattgcgcaggcacacaacacgacaaacgtctggctaccgagcatgaccgcagtctgtaaaaaagagagatgaaagttccacagattggtgcaaaacatcccgcataaaacgggaacgacaccgcgccagccaaagataaacaagattgacagcattacgcacagtggcatccacgccagaaagatataactggaatggataatggcaagtggcgaaataaaacgggatagctgaataagtaccacggtgagcgtaaacgctagtgtgaatatcttgatattttttatcaggttatgctccacaaacatgagtacactactctcactgatcggggttttcaggcacacaaataataagtttattcgcatcgcgaagcaaacagggggccagcctgttgccgatttttcatccaatgatgctttcaccaggcggcactaacccggacgtagactgtattacaaaagcggcaaaaagcagagacaaaaaacccccgctttgcagcgagggttggaaatttggtggagctaagcgggatcgaaccgctgacctcttgcatgccatgcaagcgctctcccagctgagctatagccccacgatgcgtttacgtaccaagtttgctgggtgcaaaatttggtggagctaagcgggatcgaaccgctgacctcttgcatgccatgcaagcgctctcccagctgagctatagccccgtcacgtaaagcttgtcgagttgacgggcggcatcatatgaattccgcccgaatgtgtcaacggcaaattgcaacgtgtagtttcaatcgctgaaaaatcaggcaaatgaacaattttggaaaaccgctcgcattcagtagttattcatgtcacggtttcctgtaaagtggtgttataaaatgaactactaatagacccacatacattcagggaattgttatgttcaaggagaggatgacaccagatgaacttgccagactgaccggctatagccgccagaccattaataaatgggtacgcaaggaaggctggacaacgtcaccaaaacctggcgtccagggtggcaaagcccgactggttcacgtcaatgaacaggttcgtgaatatattcgcaatgctgaacgtccagaaggtcagggagaagcgcctgccctttctggtgatgcgccgcttgaagtattgctggtgacactggcgaaagagatgacgccagttgaacaaaaacagtttacatccttgcttctgcgggaagggattatcggattgttacaacgcttagggattcgcgatagcaaataatatgaaaagattacgcaataaaatgaccaccgaagaactggctgaatgcctcggtgtggctaaacaaactgttaaccgttggatcagagaaaaaggctggaaaacggaaaaatttcccggcgtgaaaggcggtcgtgccagacttattctggtcgatacgcaagtttgcgagtttattcagaacacgccagccttccataacacaccaatgttgatggaagctgaagagagaattgctgaatacgctcctggagcacgcgccccggcgtatcgacaaatcatcaacgcgatagataatatgacagacattgagcaggaaaaagtcgcgcaatttttgtcacgtgaaggaattcgcaatttcctcgcccgtctcgatattgacgaatcagcataaataaaaaacggcaggatattatctcctgccgtttatctttttacacgctaattactgctgattttcgcgttcagcaataaaatccagcgctttgttgatacgctcgatactgcgggtcttaccaattgcgtgaacggtaacatccagtgctggagactgccccgcaccggttacggcgacacgcagcggcataccaactttacccatacccacttccagctcatccgccgtcgcctgaatagcgtgatgaacgttttcagcggtccagtcagtaatcgcggccagtttgtcacgaaccacttccagcggctgacgcgctaccggacgcagatgttttttcgcggcgtcggcatcgaactcagcaaaatcttcgtagaaataacggcagctctgtgccatctctttcagcgtcttgcagcgttcgcccagcagtttcaccagatcagccagctgcgggccgttacgggtatcgatattttcctgctcaatgtgccactgtaagtgagtagcaacatactccggcggcagcgcgttaatgtagtgatggttcagccacagcagcttgtcggtgttgaacgcactggcagatttgctgacggcattcaaagtgaagtatttgatcatctcttcacgagtgaagatttcctgatcgccgtgggaccagcccagacgcaccagatagttcagcagtgcttctggcaaataaccgtcatcacgatactgcattacgctgactgccccgtgacgtttggacagttttttaccgtcatcgccattgatcatagaaacgtgcgcgtaaaccggcaccggcgctttcagggccttaagaatgttgatctggcgtggcgtgttgttgatatggtcttcgccacggataacgtgggtgatttccatatcccagtcatcgacaaccacacagaagttataggttggggaaccatcggtacggcggataataagatcgtccagttcctggttgctgaactcgatcggaccacggatctgatcgtcaaaaacaacagaaccttcctgcgggttagcaaaacgtacaacacacggttcatcatcagcatgatgctcatggctgtggcggcagcgaccgtcataacgcggcttctcacctttcgccatttgctcttcgcgcagcgcttccaggcgctctttagagcaatagcatttataagcagtgccctcttccagcatctgatcgatcaccgcgttgtagcgatcaaaacgtttggtctggtagtacggaccttcatcccactccaggctcagccagttcatgccatccataatggcttcgatagcttccggcgtggaacgctcaagatcggtgtcttcaatacgcagcacgaactcaccgccgtggttacgtgcaaaaagccaggagtaaagagcagtacgcgcgccgccaacgtgcagatagcctgttgggcttggcgcgaagcgagttttgattttcatgaaatggccttacgtttagaaagatgccgacaaccggcaaatcctggaaaaattaagtgggcgatattctatcactcccgcctgattcctcaatgtagttcgggtttctaccttacgcattattgttttcgttgacaaattgcgcaacacggtctgttttgcgatcatcttgcttaaatttacgacgaacgaacaatttctttagaaaatgcgttgactcattttgaactctccctataatgcgactccacacagcgggggtgattagctcagctgggagagcacctcccttacaaggagggggtcggcggttcgatcccgtcatcacccaccaactactttatgtagtctccgccgtgtagcaagaaattgagaagtgggtgattagctcagctgggagagcacctcccttacaaggagggggtcggcggttcgatcccgtcatcacccaccactttctcgccagctaaatttcttgtaaaaatgtgaagtaccgaagtgggtgattagctcagctgggagagcacctcccttacaaggagggggtcggcggttcgatcccgtcatcacccaccacttcgggtcgttagctcagttggtagagcagttgacttttaatcaattggtcgcaggttcgaatcctgcacgacccaccaatgtaaaaaagcgccctaaaggcgcttttttactatctgcgatactcaaagattcgaacctgcagcaggtttgagttgagcgcagcgaaacaacggagccgctcgcggcgacggcccgaagggcgagcgaagcgagtcatcctgcacgacccaccaatgtaaaaaagcgccctaaaggcgcttttttgctatctgcgatttgcgaaattgcctgatgcgcttcacttagcagactactatttccggcaattcctgtctcctcacctactgtgtcaatgcagccaacagcttaaccatcgcgggcgtcacctgctgtgtttcataaacaatatataaatctgcagggatgcgctgtttgagcggacggaaaatgacacctggccagttcatttgtgcgtagctgtccgctatcaatgtgataccaatgcccatactgaccatagcgagtaccgtttgcggttcattaacttcgcgaataacaaccggtgaaaatcccacctgctggcaaactcgctgcaaaaaatcccagtcagtgtaaacgggcggcattgtaacaaaatactcgtcacgtagcgcttccagcgggacggtggaaaatgatgagagatgatgctcttcaggcatcgccaccagaaacgccgattcatgcaaccgtaagctggtaaaaccagtcggtggttctgtcgccattcgccagatcccggcatcaagttcgcggcgttccagcaaggccatttgcatcgcgggcatcttttcgcgaaaaagaacgtcaacgttaggattttccctgaggaatcgccgcataaccgggcgcatccgtccccacattgccgttcccactacgccgagttcaatccgccctgcttctccccgacctatttgttcaatccgagccaatacattattagcattcaccagcaatcgacgcgattcttccatcaagattttgcccgcgtgtgtcagtacgacgctgcgcgaatggcgaataaaaagctgcgtgccgagttgattttccagctctttaatatgaatgctgagcggaggctgagacatatttaaacgcgctgctgcgcggccaaaatgcaactcttccgctacggcaagaaaataacggagcaacttaagatctgttctgtatacgcgttccataattaagtgctccatataataaatacatcgtattaaattatcatggcataaagtatttcaccaccagatatccgacatacataaacacaatggataatatacccggtaatacatttggtacaggaataggcaagcgcacgattgtaaacaaagcaccaataccaaaaccaacgccggaagaaaataaaatatctttcactaattaacctttatcataaaagcagctctgaagagcagagccgcgaatccttttaatgagtcaccgctcgatgctttatcttttcagggtcatgattatatttaaacccaaagaaaaatatcactgcgagaaaaagagcatatcctgcaaacaccagccagatagtttgccagtcttttacgccatccaccgaaaagtaatctactgccatgccactcagaatcgagccaacccatgcgccgacaccatttaccatggtcataaagagcccctgcgcgctggcacgaatgctggaatcaacttcctgttcgacaaataccgaaccagaaatattgaagaaatcgaatgcacagccataaacaatcatcgacagcagcagcaaaataaatccggttgttgacggatcgccataggcgaagaagccaaagcgcagcgtccaggccaccatactcatcagcatgacggttttaatgccaaatcgctttaaaaagaatgggatagtcagtataaagcccacttctgccatctgtgaaactgacagtaaaatggagggatatttcaccacaaaactgtcagcaaactccgggttacgggcgaaatcatgtaggaacggattaccaaaaacgttggtaatttgcagtaccgcacccagcatcatggcaaagaggaaaaagatggccatgcgtggatttttaaacagcacgaaggcatccagacccagcttgctggcaagcgatgtggtcgcttttttctccgcaaccggaatcttcggcaaagtcagcgcataagccgacagcagcaatgacgcaccggacgcgatatacagctgcagactactcaattccagatgcagcaggcttactgcccacatcgcgacaatgaaccccaccgtaccaaaaacgcgaatgggcgggaaagcggtcaccgggtcaagccctgcctgggcaagacaggaataagagacgctgttcgataacgcaatagtcggcataaacgccatcgcattgactaacatcacccaaaacatcatatccggatcagttacggatgccgcataaaaaagtacgcccgcacacaccaggtgacacagcatgtatgcacgttctgcgcgcagccatttgtctgcgatgatccccattataccaggcataataatcgcggcgatccctttggaactgtaaaccatgccaacattagcgccggtgaaatgaagagtattaatcatgtaagagccgagggtaaccagccagctcccccagataaaatattgcaaaaaggacattacctttaagcgcatcgcgatgctcataatcgtttccttgtcgcatcatttggcctcacccgcgaggccgtttcttattgtttttctcaggcaattttgcgcagaaagccacaaataaggttgatgaagttctgcttagagagctccgcagccgccagcgtttgcgcatgtgacaatttcacatcgcttaaaccttccgccatattggtaatcgcagagaccgcaacgactttaaggtcgcaatggcgagctgaaataacctcaggcaccacagacataccaacaacatccccaccaataatttgcatcatgcgaatttccgccgcagtctcgaaattcggccccggatacgagacgaacacgccctccgtcagagggaaaccctcttctttcgccactttttgtaacagtgcgcggtattccgcatcgtaggcatttgccagtgagaagaagcgctctccaaaacgatcatcgttaagacccaccatcggcgtaccgggcatggtgttgatatgatctttcaatgcgaccaggctgcctgcccccacttccggacgcagcgagcctgccgcattggtgcagaacagtagctcgcagcccagcagcttaaaggtacgaattgcgtcagtcataatggtcattccacgaccttcgtagaaatgtccgcgacctttcatacataccaccggtacgccctggagatggcccagcactaactcccccgcatgaccatgtaccgtacttaccgggaagcccggcagcttttcgtaggaaattgcgacagcgttctcaatctgatcggccagcgcgccgagcccggaacctaaaataaaggccactcgtggcgtgaaatcaggtttataagtcttgataatatctatgcaaaacagcgggttatgagaaaattgaacctgagacatacatatcctttttctgtagggtggaatctaacgcctttttatagcgaggttgtcccggctcttaccaatacacttttctcacgcattcaatagcgattcgatatcgatggatttatatcttttctctattaatccacggtaaaaactgtattggcgatattaattcctttgcattaacaatatgtcgtttttagcaaaccactttattaagcaatctactaataacgatcggcatagggaattatgctatgaaaaaacatcttttaactctgacactttcctctatattagcgatacctgttgtatctcatgcagaatttaaaggcggttttgcagatatcggcgtgcattatctggactggaccagccggactaccgaaaaatcgtcgaccaaatcacacaaagatgattttggttatcttgaatttgaaggtggcgctaactttagttggggagaaatgtacgggttcttcgactgggaaaacttctataacggtcgccataataaaccaggtagcgagcagcgttatacctttaaaaataccaaccgtatttacctgggtgacaccggatttaatctctacttgcatgcgtatggcacctacggttctgcgaatcgcgtgaatttccacgacgatatgttcctgtacggtatcggctacaatttcaccggcagcggttggtggttcaaaccgttctttgctaagcgttatacagatcaaacctattacactggcgacaacggctatgtcgccggctgggttgcaggttacaactttatgctgggcagcgagaaattcactcttaccaactggaacgagtacgagtttgaccgtgacgctacctatgcagcgggtaatggcggtaaagaagggctgaatggcgcagttgcactgtggtggaatgcaacatcacacattactacggggattcagtatcgatatgcggatgacaaactgggcgaagatttttaccaggatgcgataatctactccatcaaatttaacttctgattgattactgccggggctcccggcagtatgaattcactctatatctgatacaacggatccccttcccgcccagccattagcgcattgccctggtctcgtaccacgtcccataaagcttcagcggcggtggaaagtgaacggttcttcctgcgcaccagcatcaactggcgttcaacaaccggcgtaatgcgctttaccaccagtgggctaccttcaggcaatggtagcgccagtgcgggaagaatactgatgccgatgcctgcggctaccatcgggaacagcgtcgccggatgtccaatctcctgcacaatattcgcctgaataccattgcgcgccagcgctgcgtcaatcagcggtcggctgcctgacgcgtaatcctgcaacaccaatttcgctccctgtaatgcctgccagggtacataatcttccacggccaaagcgctatcgcgatggcaaagcagaaagaaaggctcggaaagaatcgcttcacattgcagatcgcccactgggcctggatcgatgacgatgccaaaatcgacatctccctggcgaatactttccattacccactgctgcggacgatcgtgcaggacaaactgaatatctggatagcggcgatggctttcagcaatgcattgcggaataagatgcgcggaaatggtctggctggcagcgacccgaacttttccgctcagttgttgccccatacgcccggtatcgcgcaacgtgctgttcagttcatccagcagtcgctcaagacgcaaagccagctgctgccctgcatctgtaagcaccacttcacgcgtggttctgtccagcaggcgaacaccagtatgattttccagttccttcacactgtgactcactgccgactggctcaggccgatacgctctcctgcacgactaaaacttttctcctgcgctactgtgacgaaaacctttaattgttttaaagaataattcatctgttttcttcatgaatggatgcaataaatcaattttatttctcaaactggaagaagcacaatagaaccatcgatcatctggagtctttatgaaactttttcgtatcctcgatcctttcaccttaaccctgatcacggtggtgttgctggcctctttctttccggccagaggcgatttcgtccccttctttgaaaatctgaccaccgcagctattgccctgctgttctttatgcacggcgcgaagttgtcgcgtgaggcgattattgctggcggtggtcactggcgactgcatttgtgggtaatgtgcagcaccttcgtgctgtttccgattctgggtgtactgtttgcctggtggaaaccggtaaatgtcgacccgatgctctactccggttttctctacttgtgcattctcccggctaccgtgcagtctgcaatcgccttcacgtcaatggcgggcggtaacgtcgcggcagcggtttgttctgcgtcggcatccagcctgctggggattttcctttcaccattgctggttggtctggtgatgaatgttcacggtgcagggggcagccttgagcaggtcggtaaaattatgctgcaactgctgctgccgtttgtgttggggcatctttcccggccgtggattggtgactgggtgtcgcgcaataaaaaatggattgcgaaaactgaccagacgtccattctgttggtggtttatacagcgttcagcgaagccgtcgttaatggtatctggcataaagttggctggggatcattgctgtttatcgtggtggtcagctgcgttcttctggctatcgtgattgtagttaacgtctttatggcacgccgactgagcttcaataaggcagatgaaattactatcgtcttttgtggttcgaaaaagagtctggcaaatggcatcccgatggcaaacattctgttccccacatcggtgatcggtatgatggtgctgcccctgatgattttccatcagatccaattgatggtctgtgcggtgctggcgcgtcgatacaaacgccagaccgaacagttacaggcgcagcaggaaagcagcgccgataaagcttaaagcggacgcttcaggggctggaccagttgcgtcagcccctcggttttaatcagcagcgtgatttgcattagctcaccgagcttccctgccgggaactcatctttgcgggcaaaccacagcagatactcctccggcaggtcgattaagcgacgccctttgtatttgccaaacggcattatcgtattggctatttcaatcagctgctctttttccatctcagctacccagcaaacgcagcatttccgcttcgtcgatgacttcaatgcccagttcctgcgccttcgccagtttagatcctgcagcttcacccgctatcaccagatcggttttcttcgacacgctgcccgcgactttcgcgcccagttcgaccagtcgagctttagcgtcatcacgcgacatctggcttaagctgcccgtaagcaccacggttttaccagcaaacgggctgtcaatctcttccgcgttgataacgatcggcgcaggccagtgaacaccttccgccaacagctcgctgatgacattgcggttgctttcttcggcaaagaagttgtgaacgtgggatgcaacgacaatgccaacatcaggcaccttttgcagctcttcaatcgaagcggcttccagcgcttccagcgtgccgaaatatgccgccagacctgctgcggtggcctcgccgacttcacggatgccaagtgcatagaggaagcgagcaaaggtggtttctttcgctttttccagcgcgttaaccacgttttgtgccgattttggccccatacgctccagtccggtcagtttgcctgcggtgagtttgaacagatctgccggagtatggacatattctttttcaaccagctgatcgatgattttgtcgcccattccgtcaacatccatcgcacggcgggaaacaaagtgtttcagcgactctttacgctgcgcaccgcaaatcaggccaccggtacagcgggcaaccgcttcaccttccacacgctcaacgtcagaaccacataccggacaatgcgtcgggaatacaacctcacgggtatcttccgggcgttcagaaagcacgacgttaaccacctgcgggatcacgtcgccagcgcggcgaatcaccactttatcgccaatgcgtaaaccaagacgttcgatttcatccgcattgtgtaaggttgcgttactcaccagcacgcctgcaacatggacaggttccagacgcgcaacaggcgtaatcgcgccagtacgcccaacctgaaactcgacgtcacgcacaaaggtcatctgctcctgcgccgggaatttaaacgctaccgcccagcgcggggcacgcgcgacaaagccaagctgctcctgctgtgccagtgagttgaccttaatcaccacgccgtcgatatcaaagcccagcgtcgggcggtcttcttccactttgtgatagaacgccagcacttcttccgccgattcacaaagcgttacccgatcgctgaccggcaacccccactttttaaattgcagtaaacggccaagatgagtatccggcagctcgccaccttccagaacaccaacgccatagcagaaaaaagtgagcggtcgcttcgctgtaatacgcggatcaagctgacgcagtgaaccagctgccgcattacgtgggttagcaaacactttcccgcccgtgcgtcgcgcatcttcgttaatcttttcgaaccccgcctgcggcaggaacacttcaccacgcacttccagacgcgccgggatattctctccgtgcagcttcagcggaatggcgcgaatagtacgcacattagacgtgatatcttccccggtggtgccatcgccacgggtcgcggcactgactaaaacgccattttcatacagaatactgacggcaagaccatccagcttcagctcacagcaccaggtgactttctcgttgtttttcagacggtcctgcacacgtttgttgaaagcaagaaagctttcttcatcaaaaacgttatccagtgacagcattggtacttcatggcgtatctggctgaaagccgccagcggcgcagcgcctacacgttgagtaggcgaatcaggcgtaatcagttctggatgtttggtttccagctcgcgcagttcgcgcatcagcctgtcgtattcagcgtcgggaatttccggcgcatccatcacatgataaagatattcatgatggcgaagcgtcgttcgcagttctgtcagttgttgttcgattgattccatatcgcaccatcaatgctaaaaacccccgacaagcgggggttcgaagaggagttaatttgccttaagtgtatcaggcgttggcgtctttgacttcgcggatgatgtcctggtactcgcgcaatttctgcggagtcatcatacggcgctgatcgtcaagcacgacaccgcccacttcatcggcaatatgctgcgcagattgcagcatcagcttgaagttctgcagctcgtcaccgtaagacggtacctgcataaagatagtgacacccggagtagtgaaatccttcatttcaggatcaaaggttcccggtttcaccatattcgccaggctgaataacgccgggccgctgccatccgggctaagatgacgatggtaaatattcatatcgccaaaaatgaagcccgcttgttgaatgctgttaagaagcagttcaccgtttagctcgctaccgtgatgcgccgcgacgttcatgataatcaccgcttctttgcgcttcggtttatccataactggagcaggttccgctacaggctcaggctgtggtgccgctacgggttctgcaggctggaaagcctgttgtgccggttgcggtgctgaatgcacaggctgcggcgctggcgcgacctgtggcgaaactggctgctgcaacggctgttcaggctgcggctgataggcaggctgctgcaccggctgcgctggatgcggagcatgttgcggcggtacctgcgcttcaggcggctgctggaccggttgacgcggctgcgcagacgcataaggcggttggtactggtgttgcggcgacggacgagcagcctcatgctcctgagcgttagccggggcatgattcacgcggtgaacacgaacctcaccaacgccctcatcatcttcgacatcctcgtcataagaatcgtcgtcacgttttgacttcattcgttttaatggccgatcgcggaacatagaagatcgttctttacggctggtccagaaaccatgtaccagtaaagcgattatggcgatcgcgccaacaatgattaatatcagacgcaaatcctgcatcattatattctctgttgttctaacaccttgccaccacggcaaacatttactcactaagagtatttgccgattacctcaagtgcaagtgcactattaactttcacagcacaaagatagatgaaatcgtgctttttgctgttttttcgaacatatcctaactgtccattgcgcaattacccggtaaaatacgcagaattttcctgggattggtcaaaaggagctcatcctgattatggtttcatcattcacatctgccccacgcagcggtttttactattttgcgcaaggctggaagctcgtctcgcaacctgggattcggcgtttcgttattttaccgctgctggtcaatattttgttgatggggggcgcattctggtggctctttacacagctcgatgtctggatcccgactctcatgagttacgttccggactggctacaatggctgagttatctgttgtggcctctggctgtcatctctgtgctgttagtgtttggctatttcttctccacgattgctaactggattgccgctccgtttaacggtttattggctgaacaactggaagcacgattgactggcgctacaccgccagataccgggattttcggtatcatgaaagatgtgccgcgaatcatgaaacgcgaatggcaaaaatttgcctggtatctgccgcgcgcaattgtattactaattctttacttcatccctggtattgggcaaaccgtcgcgccggtactgtggttcctgtttagcgcctggatgttagccatccagtattgcgattaccccttcgataaccacaaagtgccgtttaaagagatgcgcaccgccctgcgcacacgcaaaatcaccaatatgcagtttggtgctttaaccagcctgtttacgatgatcccgctgcttaatctgttcatcatgcccgttgccgtttgtggcgcgacggcgatgtgggtcgattgctatcgcgataaacacgcgatgtggcggtaacaatctaccggttattttgtaaaccgtttgtgtgaaacaggggtggcttatgccgccccttattccatcttgcatgtcattatttcccttctgtatatagatatgctaaatccttacttccgcatattctctgagcgggtatgctacctgttgtatcccaatttcatacagttaaggacaggccatgagtaagatttttgaagataactcgctgactatcggtcacacgccgctggttcgcctgaatcgcatcggtaacggacgcattctggcgaaggtggaatctcgtaaccccagcttcagcgttaagtgccgtatcggtgccaacatgatttgggatgccgaaaagcgcggcgtgctgaaaccaggcgttgaactggttgaaccgaccagcggtaataccgggattgcactggcctatgtagctgccgctcgcggttacaaactcaccctgaccatgccagaaaccatgagtattgaacgccgcaagctgctgaaagcgttaggtgcaaacctggtgctgacggaaggtgctaaaggcatgaaaggcgcaatccaaaaagcagaagaaattgtcgccagcaatccagagaaatacctgctgctgcaacaattcagcaatccggcaaaccctgaaattcacgaaaagaccaccggtccggagatatgggaagataccgacggtcaggttgatgtatttattgctggcgttgggactggcggtacgctgactggcgtcagccgctacattaaaggcaccaaaggcaagaccgatcttatctctgtcgccgttgagccaaccgattctccagttatcgcccaggcgctggcaggtgaagagattaaacctggcccgcataaaattcagggtattggcgctggttttatcccggctaacctcgatctcaagctggtcgataaagtcattggcatcaccaatgaagaagcgatttctaccgcgcgtcgtctgatggaagaagaaggtattcttgcaggtatctcttctggagcagctgttgccgcggcgttgaaactacaagaagatgaaagctttaccaacaagaatattgtggttattctaccatcatcgggtgagcgttatttaagcaccgcattgtttgccgatctcttcactgagaaagaattgcaacagtaatgccagcttgttaaaaatgcgtaaaaaagcacctttttaggtgcttttttgtggcctgcttcaaactttcgcccctcctggcattgattcagcctgtcggaactggtatttaaccagactaattattttgatgcgcgaaattaatcgttacaggaaaagccaaagctgaatcgattttatgatttggttcaattcttcctttagcggcataatgtttaatgacgtacgaaacgtcagcggtcaacacccgccagcaatggactgtattgcgctcttcgtgcgtcgcgtctgttaaaaactggcgctaacaatacaggctaaagtcgaaccgccaggctagactttagttccacaacactaaacctataagttggggaaatacaatgttccagcaagaagttaccattaccgctccgaacggtctgcacacccgccctgctgcccagtttgtaaaagaagctaagggcttcacttctgaaattactgtgacttccaacggcaaaagcgccagcgcgaaaagcctgtttaaactgcagactctgggcctgactcaaggtaccgttgtgactatctccgcagaaggcgaagacgagcagaaagcggttgaacatctggttaaactgatggcggaactcgagtaatttcccgggttcttttaaaaatcagtcacaagtaaggtagggttatgatttcaggcattttagcatccccgggtatcgctttcggtaaagctctgcttctgaaagaagacgaaattgtcattgaccggaaaaaaatttctgccgaccaggttgatcaggaagttgaacgttttctgagcggtcgtgccaaggcatcagcccagctggaaacgatcaaaacgaaagctggtgaaacgttcggtgaagaaaaagaagccatctttgaagggcatattatgctgctcgaagatgaggagctggagcaggaaatcatagccctgattaaagataagcacatgacagctgacgcagctgctcatgaagttatcgaaggtcaggcttctgccctggaagagctggatgatgaatacctgaaagaacgtgcggctgacgtacgtgatatcggtaagcgcctgctgcgcaacatcctgggcctgaagattatcgacctgagcgccattcaggatgaagtcattctggttgccgctgacctgacgccgtccgaaaccgcacagctgaacctgaagaaggtgctgggtttcatcaccgacgcgggtggccgtacttcccacacctctatcatggcgcgttctctggaactacctgctatcgtgggtaccggtagcgtcacctctcaggtgaaaaatgacgactatctgattctggatgccgtaaataatcaggtttacgtcaatccaaccaacgaagttattgataaaatgcgcgctgttcaggagcaagtggcttctgaaaaagcagagcttgctaaactgaaagatctgccagctattacgctggacggtcaccaggtagaagtatgcgctaacattggtacggttcgtgacgttgaaggtgcagagcgtaacggcgctgaaggcgttggtctgtatcgtactgagttcctgttcatggaccgcgacgcactgcccactgaagaagaacagtttgctgcttacaaagcagtggctgaagcgtgtggctcgcaagcggttatcgttcgtaccatggacatcggcggcgacaaagagctgccatacatgaacttcccgaaagaagagaacccgttcctcggctggcgcgctatccgtatcgcgatggatcgtagagagatcctgcgcgatcagctccgcgctatcctgcgtgcctcggctttcggtaaattgcgcattatgttcccgatgatcatctctgttgaagaagtgcgtgcactgcgcaaagagatcgaaatctacaaacaggaactgcgcgacgaaggtaaagcgtttgacgagtcaattgaaatcggcgtaatggtggaaacaccggctgccgcaacaattgcacgtcatttagccaaagaagttgatttctttagtatcggcaccaatgatttaacgcagtacactctggcagttgaccgtggtaatgatatgatttcacacctttaccagccaatgtcaccgtccgtgctgaacttgatcaagcaagttattgatgcttctcatgctgaaggcaaatggactggcatgtgtggtgagcttgctggcgatgaacgtgctacacttctgttgctggggatgggtctggacgaattctctatgagcgccatttctatcccgcgcattaagaagattatccgtaacacgaacttcgaagatgcgaaggtgttagcagagcaggctcttgctcaaccgacaacggacgagttaatgacgctggttaacaagttcattgaagaaaaaacaatctgctaatccacgagatgcggcccaatttactgcttaggagaagatcatgggtttgttcgataaactgaaatctctggtttccgacgacaagaaggataccggaactattgagatcattgctccgctctctggcgagatcgtcaatatcgaagacgtgccggatgtcgtttttgcggaaaaaatcgttggtgatggtattgctatcaaaccaacgggtaacaaaatggtcgcgccagtagacggcaccattggtaaaatctttgaaaccaaccacgcattctctatcgaatctgatagcggcgttgaactgttcgtccacttcggtatcgacaccgttgaactgaaaggcgaaggcttcaagcgtattgctgaagaaggtcagcgcgtgaaagttggcgatactgtcattgaatttgatctgccgctgctggaagagaaagccaagtctaccctgactccggttgttatctccaacatggacgaaatcaaagaactgatcaaactgtccggtagcgtaaccgtgggtgaaaccccggttatccgcatcaagaagtaattcttgccgcagtgaaaaatggcgcccatcggcgccatttttttatgcttccgccagcggcggcaaaatcaattcatcgctctcatgctgctgggtgtagcgcatcacttccagtacgcgcaaccccgctcggtgcactgcatcggttaacgccttccctttcagcaagccactgatgagctgagcacaaaacaggtcgccagtccctttcaggtcggtttttacccgtgaatgggaaatgacattcacgctgtcggcagtgaccaccacaacctgcatctcctgattttcttcattaccggaggcgctggtaaccaccacccattttaatgtgtctgaaagcagactttttgcggcagcaatggcactgtcgagatcgcggcaatttttaccggtcaggatttccaactcaaagatattgggggtaattccctgcgccagcggcagtaaatattgtcgatacgcttcgggaaggtcaggtttgacataaattccgctatcaatatcgccaatcaccggatcgaccatgatcaataggtcaggatggtctttgcgtagcgcagtcagccactcggcaaggattttgatttgcgatgccgttcccatatagcccgtggttacagcacgaagttggcgcagcgcatcacgctcctgaagcgcacgcaaatagccgctaaaccattcgtccggaatcgcaccaccgtagaaagtgtcataatgcggcgtattgctcagcaataccgtcggcacggcaaagacattcaggccgttctgtttgatagcaggcacggcaatgctgttgcccacgctgccgtaaaccacctgcgactgcacggcgacgatatccgcctgcagtgccctactcttatcgttaaacaacaacaaactactcatttaattttttctccttgccgatgatcctcatcgtaatccaaccgaaactttacctgattctggcagtcaaatcggctatcacaaaacaaggataaggtaattcaatgaagaaaatcatttgtctggtcattacactactaatgacactccccgtttacgcgaagttaactgcccatgaagaagcccgcatcaacgccatgctggagggattagcacagaaaaaggatttgatatttgtgcgcaacggtgatgaacatacctgctatgaagcggtttctcatctgcgtctgaagctcggcaatacccgtaaccgcattgacactgccgagcagtttattgataaggttgcttcgtcgtcatcgattactgggaagccgtatattgtgaagatccccggtaagagcgatgagaacgcacagccttttttacatgcgttaattgcgcagacggataaaacggtgcctgcggaaggaaattaatccgctttgggaaggcatttacaggaggtaacatgaaaaaacgctttatttatcacgatgaaaaatcgaataaattttggtggatagattacgaaggggatagtttagctgtcaactatggcaaggtaggtagtattggtaaattccagacaaaagagttcgataatgaagaacagtgtctgaaagaagccagtaaattgattgccgcaaaaatgaagaaaggctatcaagaagatccaaagtttaacttcatggatcgctactattttgatgatgaagaaattgggttacatgttaaaacgtcacacccaaacttccagtgccattttactgatccactttatatgtgttgctgggatgaagaatctccttttggcagcgatgaaggtgctgatgctctaaacgttcttgaaaatagcctccgtaaagagccggatctggactgtgctgatttccctcaaatgttaattgaaactatgtggggtatgaaatacatcgctatggacagtattcttgaagaggatgttcgtgcgcaattactagtcgatgaaatgagcactatccagagcaatatgattacctacgcaactgcattcggtcagattaaagtcatgggtaaaatctcccataaacttaaaaagatgggactcaatgcactagcgcgtcatcagcttaccgcaaaaattcttcaatggggtgacggtcaggactcaccaatacttcaaaaaatgattgatgaccttacggcgtttcctcacgaaaattaaatactgcatttgtcggcagcaacaactgttaaaaaagtgcgctttgtttatgccggatgcggcgtaaacgccttatccggcctacaaaatcgtgctaattcaatatattgcagaaaccttgtaggcctgataagcgtagcgcatcaggcagttttgcgtttgtcatcagtctccgatgctattaatccttaaatccccgccccctggctaaaatgctcttccccaaacaccccggtagaaaggtagcgatcgccacgatcgcagatgatcgccaccaccaccgcgtcagggttagcttttgccacccgcagtgctccggcaaccgcgccgccggagctgacgccacagaatattccttcccgcaccgccagttcgcgcatggtgttttccgcatcgcgctgatgaatatccagcacctcatccaccagagaagcgttgaaaatccccggcagatattccgtaggccagcggcgaatgccgggaatgctgctgccctcttccggttgcaggccgacaatggtcaccggtttggattgttcgcgcataaagcgtgagacgccggtgatagtgccggtcgtccccatgctggagacaaaatgagtgatgcgcccgccggtttgctgccagatttccggcccagtggtggtgtaatgcgcataagggttatcgggattattgaactgatcgagcagctttccttcgccacgattcgccatctccagcgccagatcgcgcgcaccttccatgccctgctctttggtgacaagaatcagttccgcaccataagcacgcatcgccgcacggcgttcctggctcatgttgtcgggcatcagcaatttcatgcgatagcctttcagcgcggcaatcattgccagcgcaatgccggtgttaccactggtggcttcgattaagacatcacccggtttaatttccccgcgcttttccgcctcgacgatcatcgaaagtgccgcacgatctttcaccgaacctgccgggttattgccttccagttttaaccacacttcactgccgttatccggccccattcgctgcaacttcaccagaggcgtattgcctattgtttgttctaatgtactcacgatctctatccatacgtggtgttgcctgatgcgacgcttgcgcgtcttatcaggtctacaggttacaaaccttgccattaaaaagcccggatcgcgggaagcgcctccgggcgtttaacattcactcaacctatcaggcgctttgtgcgagagcaagttcctcatcgcgggtttcgatacgctcgtcgccgttatacagccgcgcatgttgcagaccaacgaataaacgctcgccacgctgcggggcatcgtcgccatgcatcacgaccgtcagcggttcgttgtaccaccccagcggctgcaccactaattgggtgtagtgacctttcgggctggcttccagtacctgtaccggcagcggcgaatcgaggctggtacggcggctgatatccacttcccaagggcgcaggaagagatccaccggcccctgatacgcaggtgtgtagcccagcggccagcgatgcgcgccaacatggaactgcccgccgcgaatggttccctgcaggcggttcacttcgcccataaattcgagcacaaaacgggtcgccggttcgcgccatacctgatccggcgcgtcagcctgttcaatattgccctggctcatcacaactacacgatcagctacttcggtcgcttcttcctgatcgtgggtcacaaaaacgctggtgaattttagttcttcatggagttgacgcagccagcgacgcagctctttacgcacctgcgcatccagcgcgccaaacggttcatcaagcagcagaatttgcggttccacagccagcgcgcgcgccagcgccacgcgctgtttctggccgccggaaagctgcgccggataacgatccgccagatgggcaagctggaccatttccagcaattttgtcactttcgctttgatggctgcggcattcgggcgctcgcgacgcggcagcaccgtcaggccaaaagcgatattgtcgaacaccgtcatatggcggaacagcgcgtaatgctggaacacgaaaccgactttacgatcacgtgcgtgcaggcggctcacgtcggtgccgtggaagcgaatatgcccgctggtttgatgctccagcccggcgataatgcgcagcagcgtggttttcccggaaccggacggccccagcaacgcgaccatctgacctgaaggaatatccagtgagatatcgttcagcacctgggtgcgaccaaacgacttcttaatattggcaatctcaatgctcatgatgttcctcctgctgtgcgcgtttttcctgattctccaggcgccactgcaacatactttttaaaaacagggtgataatcgccatcagcgttaacagcgccgcagcggtaaaggagccgacggtgttgtagtcctgctccagcaattcaatctgtaacggcagcgacagggtttcgccgcgaatcgagccggaaaccaccgacaccgcgccaaactcgccaattgcgcgggcgttggtcaacaccacgccataaagcagcgcccagcggatgttcggtaatgtgacgcgacggaacatctgccagccggacgcgccaagcaaaatcgccgcttcgtcttcctggctgccctggcttaacatcaccggcaccagttcgcgcaccacaaacggacacgtcacgaagatggtgaccagcaccattcccggccaggagaacataatttgcaggttatgctcgtcgagccaaccgccgagcgggccgttagagccgtagaacagcaaatacaccagaccggcaaccaccggcgatacggcaaacggaatgtccagtagcgtcagcagtaactggcgtccagggaagttaaagcgcgtcaccagccaggccagcagaatgccgaacaccaggtttaccggtacggcaatcagcgcgatcatcaccgtcagccagatggcgtgcagcatgtccggatcggccagattctgtaaaaccggcatcagccccttgctgaatgcctgcacgaagatgtaaatcatcggcaccagcaggatgaacgccgaaaccagcatcccgatgccaatcagaaaccatttgccccagttaatcgggcgcgcgtcataacgcttcaattgggtaacttccgccattaatgacctaccacacgccgaccaaagcgactttgcagagtgttaattgagaacagcagcagcagagatgccgcgaggatcaccgaagcaatcgcgctcgctgccgggtaatcaaactcctgtaagcgcacaaaaatcatcagcgacgtcacttccgtcttccacgcgatatttccggcgataaaaatcaccgcgccaaattcaccaagactacgggtaaacgacagcgccacgcccgccaccagcgccggagaaagctccggcagcaccactttgcagaaactctgccagcgcgttgcaccaagcgtttccgccgcttcttcatattccgggcctaactcttccagcaccggctgcacggtacgcaccacaaacggaatgctggtaaaggccatagccaccgcaatccccagccatgtataggtgactttgatatcaaacttcgccagccattcaccgtaaaaaccgtttacggaaaagagcgaggccagcgttaaaccggcgacagccgttggcagcgcaaagggtaaatccatcagcgcatcaagcagcgtgcggcctgggaagcgatagcgggttaggatccacgccatcagcagaccgaaaacgccgttaaaaatcgatgccacaaacgccgacagcagcgttactttgtaggccgcgaccacctgcgggttggtgatcacctcccagtactgcgcccagctcatctgggccagttgcatcaccagcgcggagagcggcagcagcaaaatcaggcacacaaacagcagactggtgccgaggcttaaggtaaagcccggcagcacgcgtctggaggagacagcaaacatcagttacgccccgccgctaacagcttgtctaactcgccgccgctggtgaagtgggttttcatcacttccggccaggagccaaatttgtcttccacgcggaacagctcggtctgcgggaatttgtctttcagtttgtccatcacctccgggttattcacgcggtagtaatagtcggtgatgatggtttgcgcctgcgggctatagagccagttcagataggctttggcggctttttccgtaccgttggcctgcacgtttttatcaacccacgccaccgggaattccgccagaatgttggttttcggaatcaccacttcaaagccctgcgcttcatactgtttacggatgttgttcacttccgattcgaagctaatcagcacatcgcccaggccgcgctcggcaaaagtggtggtcgcgccacgaccgccagtatcgaacacttcaacgtttttcaggaactgggtcataaactgttcggttttgcctttgtcaccaccgtcagctttatccgctgcgccccatgccgccagataggtataacgcgcgttacccgacgttttcgggttcgggaaaatcagcttcacgtcggagcgcaccaggtcgttccaatcgtggatattcttcgggttacccttacgcaccaggaagcccatggtggagtagaacggcgagctattattcggcaggcgcgactgccagtcggccgggatcagcttgcctttatcgtgcaggatttgtacgtcggtcacctggttataagtgacaacgtcggcttttaagccctgtaaaatcgccagcgcctgttttgatgacccggcatgagattgttttatcgtcagtttgtcgccgccgttatcttttgcccattgttgctcaaacggcggattcagggcggcaaacagctcgcgggagacgtcataagaactgttcagcagttccgttgcctgtacatggcccgccagcagcagagaagcgaccagcgcgagtgagttctttttcagtaagttaacggccattgcgcacccttataaatttaatgactttctaatagccatcatatttataacggacgtgaaaggagtaacggttttatataccgtttggtgatttggaagttgaaaagggaataagaacttggttcaacaggcgtaattgttgcagtcagtttggacacgaacagcgcggagaaaccggagcgtacacatagtacgtgaggatttcgagcactgcccggggccaaaatgacaaataaaatagcctggtgaacttagttcaagacgaaatcctccccacaaatgcagggaggaaacagaggtgaatcagataccgacgctaaccgtctccggcagtgtgctgccgccatcaatcacattctgtgtaccggttaaatagctggattcatccgatgcgaggaaggccgccagttcgccgacttccagcggatcggcgaggcgacgcatcgggattgctttcgccatttcagtcagcaccgactctggatcttccgggttcgactggcgggcaatgctttccgccattggtgtgcgcacgtatcccgggcaaatggcgttaacgcgaataccagactgcgcgtactccaccgccagcgattttgtcaggccaacaatcgccgctttcgttaaggcgtacgccgtttcgccaggatcggccaccatatcaccagtgactgaagacatcatcacaatgcgaccatctttgcgggcaatcatctccggcagcaccgccttcgtgacgttccatacgcctttaatattgatgtcaatatggaaatcgcgatcgtcatcgctcatatcgaggaaactgcccagacgacaaacgcctgcgttattcaccaggatatcaatgcgcccttctttttccttcgcgcgtttgatagctgcggctaccgacgccgggtcacgcacatcggcgacaaccgccgtacagcgatgaccacgaccacacagttcgtccgccagcttttcgatctcaggggagatatccagcaagattaggttcgcgccatgacgtgcaaaagttctggcaattccttcgccaattccctgcaatgcgcccgtaatcagtgctgtcttgcccgtgagtttacccattttaatgctctccttgttaatacagagcgttacactccattccctctgaaaatacaggataaacaaaatattgctgcggatcagctcactaattcaggaaaatctcaatccagtcgctgctttatgcatcatttcaggcgttgtgttagctcactgctgcgctgaatcattttcaatgactccacatcattgagttgcacaaggccaacaaacagtaaatcggtaacagaattttgcgccgtgcgggtagacatcgacgagctacgccattcggtttctccggaaacggtatcgagggtgaaatgcgccagccgccgcagcggagagtcagtcagagaagtaatggcaatcaccgttgccccctgctttcgtgccgcttctgcgcacaagacaatctcttttttactgccgctgtaagagatagcgatttgtacatcgccttttttcaacgcctgagaaacggtggcttgtacgtgcgtgtcggcttcgcaggccacgcgatagccaattttcatcagtttgaacgacagatcgcgccccaccagcgccgatccgcccaggcccgttatctggataaacggtgctttactgatgacctcaatgattttttgcagccgcgcgtaatcgagcaacgcgcaggtttgctccagcgccagctctttttcgcgattcagtttgcgcgcgatcacttccagcgaatcatcactggtaatcgaactgtgcaggtgcagtgccgtggcattcgttttctcccggctggcactgtattcgcctattaacgccatacgcaattcagtaaatccttgcgcgccgagtttttgggcaaatttcactatgctcgactggctaatgccgagctgtttcgccatctgccgtgaagaaacggattgcagctcactcacgttggcctgcagaaagtcagcgattttttgctcgttttcggtgaattcactccccgcattgcttattttcgtcaggtacaacatcttccactctcctgggctggcagcataaattccgcttaagttcttatgacgctcttcacactctgcgagtgtagactcaatgattcctttaagcctgtcaattcgggatatatgattccatacatctgcaattatttgatcgtaaatagtaaggtcaccaccgatgcaatttgaaaagatgattactgaaggctcgaacaccgcctcggctgaaattgaccgcgtatcgacgctggaaatgtgccggattatcaacgatgaagataaaaccgtaccgcttgccgttgagcgcgtactgccggatatcgccgcggcgatcgatgttatccacgcccaggtaagcggcggcgggcgtctgatttacctcggtgcgggaacatccggtcgtctggggattctggatgccagcgaatgtccgcccacctacggcgtgaaaccgggtctggtggttggtttgattgctggcggcgaatatgccattcagcacgcggtggaaggcgcggaagatagccgggaaggcggtgttaatgatctgaaaaatattaatttaacggcacaggatgtggtggttggcattgctgccagcggtcgcacgccgtatgtgattgccggactggaatacgcacgccagctcggctgccgcacagtgggaatttcctgtaatccggggagcgccgtttcaaccaccgctgagtttgccattacaccgattgtaggtgccgaagttgttaccggttcttcgcggatgaaagcaggtacagcgcagaaactggtgctcaatatgctttccaccgggctgatgattaaatccggcaaagtgttcggcaacctgatggtcgatgtggtcgccaccaacgaaaaactgcatgtgcgacaggtcaatattgttaaaaacgccaccggatgtagcgcagagcaagcggaagcggcgttaattgcttgcgagcgcaactgtaaaacggccattgtgatggtgctgaaaaatctcgatgccgcagaagctaaaaaacgcctggatcaacacggcggctttattcgtcaggttttagacaaggaataacccatggccaaagagatcagcagtgaacttctgaacaccattcttacccgtgtcggcggaccgggaaatatcgccagttgtggtaactgtatgacgcgcctgcgtctgggtgtacatgacagttcactggttgatcccaatatcaaaacgctggaaggcgtgaagggcgtcattttgaccagcgaccaggtgcaggtcgtttttgggcctggtaaagcgcatcgtgccgcaaaagcgatgagcgagctgctgggagaagcaccggtacaggatgccgcagaaatcgccgcccagaacaaacgtcagttaaaagccaaacaaacctccggcgtgcaacaatttctcgccaaattcgccaccatcttcacgccgctgatccccggttttattgccgccggtctgctgctggggatagcgacgttaattgccacggtgatgcacgttccggcagatgctcagggaacactacccgatgcgctgaattttatgaaggtgttcagcaaaggtttgttcactttcctggtgattctggtgggctataacgccgcccaggcatttggcggcacgggcgtaaatggcgcaattatcgccgcgctctttttgctcggttataaccccgcagcgaccaccggttactacgccggttttcacgatttctttggtctgcccatcgatccgcgcggcaatattatcggcgtgctgattgccgcgtgggcctgcgcccgcattgaaggcatggtgcgccgctttatgccggacgatctcgacatgctgctgacctcgttaatcaccctgctgatcaccgctacgcttgcgtacctgatcattatgccgctgggtggctggttattcgaaggtatgtcatggctgtttatgcacctgaacagtaatccgttcggttgtgcggttttagccgggctgttcctgatcgccgtggtatttggcgtgcatcagggctttattcctgtttacctcgcgttaatggacagccagggattcaacagcttatttcccatcctttcaatggcaggcgcgggccaggtgggcgcggcgctggcactctactggcgggcgcaaccgcacagtgcgctacgcagtcaggtacgcggggcgattattcccggcctgctgggcgttggtgaaccgctgatttacggtgtcaccctgccccgcatgaagccgtttgttaccgcctgtttaggcggcgcggcgggcggtttgtttatcggcctgatagcctggtggggtctgccgatgggcttaaacagcgcctttgggccgtctggtctggtagcgctgccgctgatgacttccgcacaaggcatccttccggccatggcggtttatgctggcgggattctggtggcatgggtttgcgggtttattttcaccacgctctttggctgccgtaacgtcaatctggactgatatcatgaaacggacaatgctctatctttctctgctggctgttagttgtagcgtcagcgccgcaaaataccctgttctgacagaaagctcgccagagaaagcagggtttaacgtcgaacggcttaaccagatggatcgctggattagccagcaagttgatgtcggttatcccagcgtaaacctgctgatcattaaagataatcagattgtgtatcgcaaagcctggggagcggcgaaaaagtacgatggcagcgtgttgatggaacagcctgtcaaagccaccaccgggacgctgtatgacctggcctcaaacaccaaaatgtacgccacgaacttcgccctgcaaaagctgatgagcgaaggcaaactgcatcctgacgatcggattgcgaaatatattccggggtttgccgatagtccaaatgacaccattaaaggcaaaaacaccctgcggatttctgacctgctgcatcacagcggcggtttcccggcagatccgcaatacccgaataaagcggtcgcgggcgcgttatattcccaggataaaggccagacgctggagatgatcaagcgcacgccgctggaatatcagcccggcagcaaacatatctacagcgatgtcgattatatgctgcttggatttatcgtcgagtcggttaccggtcagccgcttgaccgctatgttgaagagtcgatttatcgcccgctcggcctgacacatacggtatttaacccgctgctgaaaggctttaaaccgcaacaaattgccgccacggaattgaacggcaatacccgcgatggcgtgatccatttcccgaatatccgcacctccactctctggggtcaggtgcacgatgaaaaagccttttattcgatgggcggcgtttccgggcacgcaggtttgttttccaataccggcgatattgcggtgttaatgcaaacgatgctgaacggcgggggctatggtgatgtgcagctgttcaatgcggaaacggtgaagatgttcaccaccagctctaaggaagatgccacttttggcctcggctggcgcgtgaatggtaatgccaccatgacgccgacgtttggcacgctggcaagcccgcaaacctacggtcacactggctggaccggaacggtgaccgttatcgatccggtgaatcatatgacgattgtgatgttaagcaacaagccacattcgccggttgccgatccgcaaaagaatcccaatatgttcgaaagcggtcagttgccgattgcaacttatggttgggtagttgatcaggtgtatgcggcgttaaagcagaagtaataaaaaggccagtcagtaatgttactggctggtctgagagtgctgacaaacgcaaaactgcctgatgcgctacgcttatcaggcctacgtggagcccacaatatattgaattagcacgatttcgtaggccggataaggcgttcacgccgcatccggcgtgtacaacgcgcacttggtcaacaatctgaggccagtcagtaatgttactgcctggcctttaatcaatgaatcagaaacgcttacagcgccatcaacttgtccagcgacggtgcgaaataatagccgccggttaccggtttggtgaaacgcaacatcgcatcacgcttaccatcggtatcgccaaacatgctcagcagttgctgctcaatgttatgcagacgcgcgcagtaggcgcagaagtacagaccgtgagtgccactggcagtgccgtacggcaggctctggcgaacaatcttcagccctttgccatcttctttcagatcaacgcgggtgaggtgagaggtttccggacgttcgtcgccgtcgatctcttcgttggcctctttggtgcgcccgatcaccatctcctgatcgtgaacgctcatccggttgagctgcttcaggttgtgttcccaacgctggacaaacacatagctgccgcccgcatccacgccgtctttgataaccgccacttcgcgacgcgtctcttcacccgccgggttttccgtaccgtcaacaaagccgctcaggtcacgctcttcaacccaacggaagccgtggatctcttctttcacttcaatgcagtcaccaaaggcttccatcgccgcctgggcgacagagaagtttacgtcgtgacgcagagaaagaatgtggatcaacacatcgaactgggtcgtcggcgcaaggcctttaccgtagcccggaaaatctttcagctcttctgccccaacgccgccgctcagagcgcgccaggtgttgttaccaaaggcaaccaccgcaccaagatgcgcgtccgggaatttcgcttcaaaagttgccagtttgtcggcaaatgttttactggccgcacgcagggcgtcaacttcccctttcacgttggcttcgatccaaatcgccgcgcggcaatgttctggcaaaatgccactctgaacctgagacattgttcctcctgaaaataataatgccacgcaatccgtggcattgttgagcgctattttacgtgttttttcgcggcggcggtttgttcagacgcaaattaacgccgccagataattttactgactttccagtttttcagggtatcgtccgaaggcattaacccttcaggaccacgccattccccgctgaactggtagctaatatgttgactgccttcggctttacattcgacggcacgattatcatcaccatcagctttttggcaattgccaaatgctttgctgtaaaggtcgctaaacggtgtaccgattttaacaccggtgtcagcaggaatatcgctatccagcacgtcaatgcgactgatcgtgccttgatcgccgttaatcaccatcgccacgttgtcgcccttcatcacttcaaaaaagcgcaccacgttgccgttcgcggttttcattccgctgcgcaggcgataatcgccatcaagcgcatcggcaatggcttgttcttgcagtggtgtggacgccgttaattcacccacgccctgctcgctcactttggtggacgacccaaaccagttccacgggttagcggcagaccagttaactgacgacatcgtggaacagccggtcagcatcaatggcatagcgcataacattaaacgcagcgatttcatgtcacttcctttggttattcaataacgttgcttggagtgcaaattcaccaaaaagtgccgttattcttttacttcataaaaacaagcgcgtaaacgtcgattggtcagcagccagattaacgccacaatatccgccactaccagcgccagaccgataccgctaacggattcaccgttcagccacagccacggttgccagcaaagtaaaaccacctgcgccaacagcaacagaaaatagagtacacgccaggtgcgaggaaacgtagcccgccgaccgctcaacaaaaacgccagcaccgccggaatgccaggaatcagccccagccagaaattatcgtgatcgggataaaacagatttagcagcgcagtaccctgctcgcgcgacgcaccggcaatgacaaacagcacccaggttcgcgcctgaagcaatagcacaagccagaagagcaagggtaaacgcaggcgaccgtgcgcatcataatggacaggatgaaactcagtactcttcatcttcaatcaaacgcttacccagactcagcacgtcggcgtgttcatatcccaggcgttcatacattccgagcaccatgtcgttatcttccggcacattgatctgaattttcgggcagccacgagcaatcagctttttctccagccgattaagcaacgcattggcaatcccacgcccacgaaactctggatgcacgccaagataataagcagacccgcgatgcccgtcataaccgcccatcaccgttccgaccacgtcaccgtttacctcagcgaccaaaaacaaactgacgtcatggttcatcttacgctcgatgtccatttccggatcgttccacggacgcagcaagtcgcaacgctcccaaagggtgatgacctcttcgaaatcttcctggcgaaatacgcgtatctccatggtattcgttacctttttgcgggttaaaaggctgattatggcgtgaacggtcgaattagccaatatctgacgaaaatcggttgaaaaagtggcataatggggagttgtcaactattgaaatgaaaagtaaaacaattctcaacagcaaaccgtcgtaacggattacgcgatacgatataacatctggaactttattattacaactcaggccgtatgagcacttttaaaccactaaaaacactcacttcgcgccgccaggtgctgaaagccggtttggctgccctgacgttgtcaggaatgtcgcaagccatcgccaaagacgaacttttaaaaaccagcaacggacacagcaagccgaaagccaaaaaatctggcggcaaacgtgtcgttgttctcgatccaggtcacggcggaattgataccggagcgatcggacgcaacggttcgaaagaaaaacatgtggtgctggcgattgctaaaaacgtccgttccattttgcgtaatcatgggattgatgcgcgtttaacgcgttctggcgatacgtttatcccactttacgatcgcgttgaaatcgcccataaacatggcgcagatctgtttatgtcaattcatgccgatggctttaccaacccgaaagctgccggtgcttcggtatttgccctctctaaccgtggggcaagtagcgcaatggcgaaatacctgtctgaacgcgaaaaccgcgccgatgaagttgccggtaaaaaggcgactgacaaggatcacctattgcaacaagtgctgtttgatctggtgcaaacagataccattaaaaatagtctgacgctcggctcgcatattctgaagaagattaagccggtgcataaactgcacagccgcaacaccgaacaagcggcatttgtggtgttgaaatcaccgtcggttccttcggtgctggtggaaacctcgtttatcaccaacccggaagaagaacggctgttaggcacggcggcgtttcgtcagaaaatcgccacagcgattgctgaaggcgtgatcagttatttccactggttcgacaaccagaaagcacattcgaaaaagcgataagttatgaaacccgacgcacaccaggttaaacagtttctgctcaaccttcaggatacgatttgtcagcagctgaccgccgtcgatggcgcagaatttgtcgaagatagttggcagcgcgaagctggcggcggcgggcgtagtcgggtgttgcgtaatggtggtgttttcgaacaggcaggcgtcaacttttcgcatgtccacggtgaggcgatgcctgcttccgccaccgctcatcgcccggaacttgccgggcgcagtttcgaggcgatgggcgtttcactggtagtgcatccgcataacccgtatgttcccaccagccacgcgaatgtgcggttttttattgccgaaaaaccgggtgccgatcccgtctggtggtttggcggtggcttcgacttaaccccattctatggttttgaagaagatgctattcactggcatcgcaccgcccgtgacctgtgcctgccatttggcgaagacgtttatccccgttacaaaaagtggtgcgacgaatacttctacctcaaacatcgcaacgaacagcgcggtattggcgggctgttctttgatgacctgaacacgccagatttcgaccgctgttttgcctttatgcaggcggtaggcaaaggctacaccgacgcttatttaccaattgtcgagcgacggaaagcgatggcctacggcgagcgcgagcgcaatttccagttatatcgtcgcggtcgttatgtcgagttcaatctggtctgggatcgcggcacgctgtttggcctgcaaactggcgggcgcaccgagtctatcctgatgtcaatgccgccactggtacgctgggaatatgattatcagccaaaagatggcagcccagaagcggcgttaagtgagtttattaaggtcagggattgggtgtaactccctcacccccactcccgcatccgctgatgcagcgtcagtgacggcttctcggaaaacagctgctggtaatccgtggcaaattgccccagatgccagaatccccactgcatggcggcgtcttttaccgtcatactttgcgaccacggacttatcagttcgcggcgtacggcgttcaggcgaatgcgtttcagccacgcgttcgggccaatgcctaaaatagcgtgaaacgcgttttgtagcgtgcggcggctgacatgcagttgattacacaaatccagcaccgtcaccggttcggacatgttttccagcacatattcacgggcgcgggaaagcaatcgacggtaactctgatgactgatgctttccgccgtcaccattggttgcgcttcttccagcatggcccccatcgccattagcaaattatcccccagcacttttcgcactgcaggctgatggagattttccggattctcgcaaaacgtcgccagcgcctgttggacaaagccccacagcgcggctttatgctgctctttcacttccagcgccgactggttacgcaacatatgtaatacccgatccgggttatgcaaaaagttagcctgccgggtgatgacatcttcagaaagcaccacgcccaggatcgtgtaatcatccggcgtgctcagttcaaattcagtgccaccagggcgggtggcgatttccgcgcttcccagacattgcgaaccgataaatccctgctcaccgcgcgtcgccggaatgccaaaccagaacgagttcggccagaccaggcacgactgacgcagcgccagaccggtgtattcacgaaaaacctgaatatcatcgagtagaatttccgtaaattcaccatgaaacttgcccggatgcagctgatcgtaaatctgctgccaggcggtaatcgttaaagcatgttcatagacatccgttgtctgtcgttgatgaacattatccacttcgaccttcggcgtgagcttcaggttttcgggtaagggttcatgataaagatggtgcaaattggctgtacgggtctttttcatgatgttaatgccgggtgttgtaggacacccggcacctccgacaggttaatggggcttgagacgataacgactactgcgtttacgtaacgtcccggcagaaaagagctgttcgagcgcatttctggctttttccagcggccagccaaagtgggcagccacttctcctgccgtcattccctgacgtactgatgttaacagcgccaacaactcgtcagcagattccgcgacgataactggcgcgtcgggttcccttacgggttgcttcggctggcggttaaagccagtaaccagccactgggtgtcatcgtctggccgaccgatctccttgcggctgatgacacgcccggtacgcatcgcggcagcacaacctgcgtccagcgccgcacgacacgccgccagatcgccttccaccaccagcgttaagcgaccagggtcaagcacttcgtgactgagcagacgaacgttagctgctttgagcatggcatccgctgcatctatcgcggcgaccatgccgtccacttccagcaatcccagtgcattgatcatcggcaacctccgttacgcacgctggattggattacgcgcgatttccagcactgcatcggtaaaggcgttacaggctgctttacacgctgcctggctaccggttaaaaatgctgccgagtagttggtttcagacggtggcgggacataggtcgccagctgtacgtcggcagacttcagggctgcatcaatgccataggtcgcttccagcggcggtgccaccagatacgccatcggatcgccaagcgtgatcccggcggttgatgagagataagaaccggtacgcgaaactacatgtgccaggaatgccgtatcttgcgcgtcattagcccactggaaagctgcgccattttcaatatgcgcaatcatcgcatccagacctgcacgcacttccgccgggtttggcccaccaagcataatcagcacttcaccggcagtcggtgacgggccgtgtgcagcgcccgcatatagcgagcggccatacaccacttccaccatcgcctgcttggtcgcttcatcagcggcaatgtaggtgacgtcatcggagtcggcagaaatcagaccgaggctacgaatatgcggcggcaatttcagttcacgcgcaaaatcggcgttaacggaggcaatcacccgcatagcggtgacagacggtcgaatcaaatctaaagctggcatgatgcctccttatcgggtcatgttgatgccggatgctttctgctccagcatacgtttcgccaaatccacaatgacggctgcggcttcaaccggcggcgtgccgccctggtgaatgttagagatacaggtgcgatcggcctcaacggtggtcgccatacgcggcgagtaaacggcgtagcaggagaggctttctgactgacccaaccccggacgttcgcccaccagcaggatcactactttcgcgccgaggatctcaccgatctgatcttcaatcttcacgcgaccataacgaacaaagaatggtgtaccgactttcagcccggcctgtttcaggcccgccatcagcggtggcaggatctcttcgtagttcacggtgatcgcatcagttgacaggccatcagaaataacgacctgtacgtccggattggcaacacactgcgctttcagcgcttcaacagcttctgcacacaggcggcggcccatatccgggcgagtcaggtagagatttttgtcgctaatttcagagcgtacttccagcaagccctgcgctttcacccactcttccggcacttctttcagtacggtatctttcgaacgagagtgatcggccaggaaacgcagcagcgcctgcgtacgtggacgcggaccggcacgaccggtacaaacgcgggccacggtgctgcggcgcagttctgttaatacgtctgcgcgatgcggattttcaacaccaatccacgcttttgcttcagcggaacctaaatccagcgcacagctttccgaggtcaccggtgccgcacagttggtggtggcgcactttgcttctgacggcgcgggggccgcttgtcccattgacgccatcacgctgcgtacaatttcttcaatctgtttttgatccatgatatgttatctccgcgtcatcagaagaacagtgacggatcgcccgcccgtttggtcaggcgaccgtttgccataatgcccatgctttccagccagcgttcaaactccggtgacgggcgcaggttgagtaactgacgcacagtggcggtatcgtggaatgcggtggtctggtagttgagcatgatgtcatcacccagcggcatccccatgatgtagttgcagcctgcggtggcgagcaggatcatcaggttttcgttgaggttctggtcagcgtcagcgtggttggtataacagcagtcacagcccatagagatgccgctcagcttgcccataaagtgatcttctaagccagcacggataatctggcggtcgttgtagagatactccggcccaataaagccgaccacggtgttgacgataaacggatcgtaatgacgcgccagcccgtagttacgtgcttccatcgttacctggtctgcgccgaagttagcgccagcggatagcgcagagccttgtccggtttcgaagtagaggcagttttccccggcgatacggttgaactccgcgcccactgcgcgcgcttcgtcgagcatcgccagctccacgccaaactctttcagccctttttcgctgccacagatactctggaaaatcagcccgcccggtgcgccacgacggatcgcttcgatctgggtggtgacgtgcgccagtacacagccctgagttgggatgttgaatttgtcgatcacgccatagatggtatccaacacgcggcttaagttttccacgtcgtcagtcaccgggttaacgccgatcaccgcatcgcccaccccgaaggaaagcccttcgtagatttgcgcggcgatactttgcacgtcgtcacgggtgtcatttggctgcaaacgggcgctaaaggtgcccggaataccgatggtggtattggcctttttgattaccggcattttcttcgcgccgtagatcaggtccgcgttggagcaaatcttcgctaccgccgcgaccacttccgaggtcagccctttgcgggtaaaggcaatgtcgtccacgctggtttcatcgctcagcacatactcacgcagttcgctgatgctccagtttttaatctggttgtaggccgtttcgttaacatcgtcctgaatcagccgcgtcacgcagtcatcttcataggcaatcaccggattattgcggatgtccgctacggtcatttccgacaacacctgctttgccgccacgcgctcctgtgagcttgccgctgcgacgcccgccagcacatcccccgaacgcagttcgttggctttagccagcacctcttttacatccttaaactgatatacattgccgaacaatgtggtctttagtttcataagtcgttccctcaggaagaatcgatgattggcatttttcacagcattctaacaatcacgtttcatcgtcagcccttgtcgtgtaaggtggttgcctaaacacgcccgttattcatcacgccgaacgcgccggatacatgatcggggttatccagtcgttaaatcaaggtatccggttttgagcaagacaccactcacagcaaaggccatagacgccgcacagccgcaggacaagccctataaactcaccgattcactgacgccggggctgtttttgctggtgcatcccaacggttcgaaatactggcgattcaggtattggctgaataaacgagagtttttgcaggccattggagtttacccgctaatcacactcaaagaagcacgcaggcgcgccacggagagcagatcccttattgccaatggaattaacccagtggaacaagcccgcaaggaaaaagccattgatgcgctcaacatggcggcaggatttaagaaggtggcggaagactggtttgctaccagggttggagggtggtcggaatcctatgcaaaacaggtcagatcggcactagaaaaagacgtctatccggtacttggcaagcggtcgattgtcgatataaccgcccgtgacgtgctggcattactccagaagaaagaacgtaccgcaccggagcaggcccgcaagctacgccggcgcatcggtgagatcttcaagtttgccgttatcaccgaactggtaacgaggaatccggttgcagatcttgatacggcactgaaggcccgccgacctggtcacaacgcgtggataccgattagtgaaattccggccttctacaaagcccttgagagggccgggagcgtccagattcagacggcaatacgtttgcttatattaacggcattaaggaccgcagaactgcgtttgtgccgttgggaatggataaacctggaggacgcaacaatcacattgcccgctgaagtcatgaaggcccgccgcccgcatgtggtcccgctatcacggcaggcggtcgagctattgcaggaccagttcacacgcagcggatacagtgctttcgtctttccaggccgattcatggataaacccttgtcagccagcgcgatacttaaagcgcttgagcgtatcgggtacaagtcgatagccacaggccacggctggcgcacaacgttcagcaccgcacttaacgaatcaggcagatactcgccggattggattgagatccaactagcccacgtcccgaagggaataaggggcgtttataaccaggctgcctacctgaagcaacggcgagcaatgatgcaggattacgccgacgctattgattcaatattggcaggtaacggcaatcctctagaaccggaatgaataattaagcggcttttttgcaaagcgcaattttgcattttgtataagtatttgttttgtgtggtttaactatcacctgataagaaacctgtattcaatttgccggattcgtccggcttttctttttcgctaattattccattattccaattaagtggaataaattattcaatatcaagaacttaaatccatgtttgcaacgaaagatccagagttcgaaaataggatcaacacaaataaaagcccccggaatgctgcaacatgccgggggcggtatgagaaacaagctaaaggagaatttctcatgtctgatatgctagcagtagaacaagaaacaaacaatgatgttcgtcaatttttaaacaaaattaacgagttacggaataaagcacccaaaaacgaagagactaaacacgaagaacacacgccagataatcacgaggaaacagatcatcacgaggcaaaacagcaggagcaagcctggcgtggcaacctgcgctacctggacacattaaaccgacttgatgaagtattgccccgcaaactgtacgaaagatgggagaaagaacatacagtcaacgacgaggctgtgctacgtgctctttgttacttcgctggtactggcaaaaactcacagttgggatggtgcagggttggtaggggaacaatcgacaaacgagccaggctatcaaaaaacacggttaaaaaatgcctcgatcgtctggtcaaccacttcaaacttgttgagcgtactgaaggctatataccaggatcggcagaaagggagtgcaacgaataccagttattattcaagccgtacaacatgaaataacggaatcaggcgggcaatgttcccgccttttctttgccttaattccatgaattcaggtgggtcaaaagttgccgttagtggtgggtcaaaagttgccgttaaggtgggtcaaaagttgccgttaaggtgggtcaaaagttgccgagtaagaattctactattaagaattctaggcgacgggagttttttagcctcccggtcggtcatagagagtcgcctagagttaaacagaagaattatttcgccgcctgataggtcggctggttgcgagcattaaccatgctgattagcgcaatcatttccagcaagctggaaacgcccattcactcacgcacaacctgaacagcagaccaacaaaccatcatggcattcgttcatggggagcgcggtatatctcaaagggtgatttcttattggtgggccttcggaaggcttcgagcaattgccagcttaaaagacgggcttagcagtgatggttatccgccacgaatgtccgtcatattgcattgcgcagaaacgcgtggcactgagggagttttccgaattagttttggggaccctttccctgcttctggagcaaaagacgaacggcaaatgcagtgcttccttgtacgactgcagcgaagaagaaaagctgtttgttaagcgcctgaagttaatcaaagcggatatccacgcccagctgaaggcctgtgattgcgatatttctgaatgacaggtggaatcatgaaacacgtttttaaatatcttgattttgcagaagaccgcgaacacgcagaatcagtggcgaccaaagagttaaaactggaccacgtagaaaaattcgctatccgcgatctagccaatgatatcaaagagcgtgggtgtgttgagcttgtccagcctggtggattcgatgagctggttcagatctatgaggccggaggcgatggaatagagccactcaattgtggaatcgaatcaaggaaggtggcaattgctgccctgcttcgcgtcatgcgtgaaccagactttcaatgcctggaaatggttcacgaaatcataagaattgctagagatttggaagcgccagttgacgctccgttagattgctaacgccaaaattagcgctgaattaatgggtaattattgcggtttttgtcaattttcaacctcaattcttgcgaaaaatggcaaaaataacggtatttttcatcatttattgggggttttatggaaggcgaactgatagaaaacaatgggttagacatttatgacaccagcgaaacaccgaaaaagcgcggtcggccagctaaatataatgaaaaaatagcaacgcaaatcgtcctattggtaagcgaaggttatagtttgcgcaagatcagcatgatgccagggatgccgagccaccgtcagatgatgcgctggcaactggagcatatggacttcagggaagggatagcctggatgtcgtggctatggtgcgctgaagctggccgacgtgccgtcgagataatcgacgaggttgatataaacgcagaggatgggccgaagcagttgcgcaaagcagaagcaaaggcaaaggcactactggcagcagccaagctgaatagtttgaaacattcaccatttggagatgacaaacaatgagcctgatccgcactgaaaccagagacacaaaacgcgcagctgacccactgcacgacctgcgtagcaagccgttttctgagtggggcgaagatgaaatcaggcgttttaatctgatagacgcgcttcttgagtttgtctacacagacacatccagcccgttcggtatcggcatgaccttcgattacacggagtgctgggaaattggtgttcgtgacgactgcctggtaatgacacgcgttaagccggtgcatccagaatatgcgaagcactggaacatgaaaggcgtcatgaatgacaaaacccgcttccacgccgacaagtgggtagggtacagcaaggtgcttgcctgggtgagcttatcgcacaaagacaccttcacgggtgcgaaacggtttcaatacttccaaacgatgtacgacatggaacggcaaatcaacgcaaacctgccggttggcggccttcccaacgttgacacagagcgaactggcaaactgttccaacgcgatgacttttctgaggatagccatgccaacgatccgaagttggttggtgatgattacgtcccccaggcaccggagcaaatcaactgaattttcggacaaacgcgcgcgtagccgacgtcagcggcaagactggcggtcatttccccgctcctacgcgaaaaatccctcacaactaccctgcaaattttccagatttcacgtacacgcgccaaaaataaaggcccaggcagttagcaacctacccgggcctttctcacaatccccgctgacattatatcacccatctttccgttttcaggtgggagactgatggccgccgacgttgcacaattgattaatttctgaacattcaaatcaactcccaccaaagccaacaagatgggaggtgaattttgtgatgcagatcgctttttcccttcaggcatttttgtttaattcaatcaacgaaaggcagttcccaacaacaaaataaagatgggaggtaaaaatgaaacggtgggaagtggctttactggtgatggtaatgttggtttgctgtattgaactgtgaaggaggacgccatgaaacttttaatcgcaatcatcctgatggtgctgactggtgtttgctttgcagatgttggtgattacaggctgaacggggaggataacgcaagaattgaatcagtcgttactgataactgtgaaaaaacagccgtattggtaggcggtgacaggcttgcgagggttgagatcgaatatatagcgacattgtgcaagccggtggctttggtgattatttacgacagatttgacgatatagcggcaatccctcttaaggtgacgttgaaaaaggtattgaaagagaatagcgatgaaaagattaacctattgaacaagatgggggatctggctggtcgtatcgttgcagagcagtatttaggcatgagttttgagtaaggaggcaatcatgaaagtgttaggtaatattttatggtgggcttttgttggtttcatggcttacgccactttgattaagccggacaacactgatccagctgttgtgaactatgaagagcctttgcctatggagcttgccaactatggcgaaccaggtgaaggggcgaaaatcatgaatgccgcaaaaataatgggtcgcgactacgcatggaaacatgtaaaagaagacaggttgccatgtctgtttgccgccggggttgttgctgataacatcctggtaaaataccatttcagcaatgaaactgagttcaaacttaaagcggcagcggtcagagaatgcgccaacgtagcagaaaacaacggctttgttttggtaggtagagtatttgaaaaacgtaattgattgcgaatagcaacaactaaacaaccaatacacccggcccctcgccgggttttttgtgatctgcgtcaatattcccttccgttacgcttaccctccaccaatacgcgtgttaacctcccaatggattctatgagatgggagataaaaatcatgagttacgaaatcaaaatttgcgacatcctcaaaggcgctgcgatggaaggacaatataagggcgctcaacgtggggccaaatgcgaggagatcgcaaacgagttaactcgccggggagttaaaaacaacaagggagaggttattactaagggcggcgttagccattggctggaaggtagacgggagccaaatttcgacactctggctgaactgtgcgacatgttcggcgtttatgccctgatgccgatgcgtggcggtaaatggattcgagttcacccggaagaccgtggagaaatggaattacgcgaggctgtagctgaacgagatgctattatcgacgacctgaaggcccgtatcgctgagcttgaggcggcactagcaaataaacaagtcccagcagaagcggaagagatgggaggtgaaaaagtggaagaagtggcagcagagcaagcgcccaacgatgaaaaagagatgggagctaaggagtgggttaacccgaacccgaaaaaatacagcgtcggcatgttgtgtcaggtactggctgcaatgggcggcgaatacctgggcaacaacgcagggttacagcagaagatcactgtgttggataacgacggcaaccggaagccaatcagtaacggcgcgttttatcgactgattgagcaggccaaagggagaggattgattagcgttgaacaggaaatcaaacacaagaaagacgaaaacggcaaccagatcggcaaaggcaagaaaggtgacaagctgataactttgcttcccaactggattgataagctgggagacgaataaaccagccttcaaccccatctcatcaatcaacgcccggccccgctgccgggtttttgctatgcaccacaattaccccaaccggatacacagccggatacaattccaccagcacccagccacccagcgccaccgctggcgaataccgcattcaggaaggaaatgcgagtgatttcaccgtcaccggcacaaccgatccgccaaaaagaggcgtaccaatgtcgatatagtcccccgcgcggacaatcacttcgtcaatgactgccaacgggagttgttgtagctgtgggcgcaacaacatgcccagagctttaccaaagtcctgcccggccaccaccagcaggggatgcggattcggaaaacgcgcgacgaaatcgaccaacgcgttgatgaccgtcagtaccgcggcgtaacgcacaggcagcgaggcgggaagcgccagcacgtacgcgtcagttttgggatcaagatccagctgaatcagcgcctgttgccaggcccccaccagatccgtttcatcaatcgggatcgccaccggcaaattgcgcagcggcagttgtacgccctcaagccagattgtgctgccagagagcgaaagggtatgcgcgcccgcgccaatcaccgtggcgcgcacggtttgcgccggaaactgtacgttcatctcacgcaggcgcggatggtcatgcagcgcagttgccagcagcgggccaatatcggcaaaacagaacgggtcggcgggctggtggcgataacattcgcccacgccgccagaaagcgtaatgatttcgggcgtaacacctgcgggcagcaaaccggtttgcatcaatgcctgcgcgagcggtgagagcgttccgtcaatcacttcgacaatcagttctgccatccgccgggtcacctgcaccagctgcgcgccggtcagcgaacgggcgtcggtgcctgcaccgaagcactcatccacaatcatctgccccggtttatgagcgtaaaccacgcgcccgtggctgtcggtttccagcaggcgaccaccgacgttgaggcaggcagtgccgctgatttttccggcatcgaacagggcgtagttcgcggtgccaccgccgatgtcgatattcagtacccgacacagccgttgttcagaaagggtttgtgccccggctccgtgaccggcgatcacggattcgaggtgcggcccggcgctggcaacgacaaaatcgcccagcgactgagagagcgccatcaccgccgggcgagcattgcgggttttcgcgctttcaccggtgatgatgatggcaccagaatcaacgctttccggctcaatacccgcagcatgatattgctcgagtattaaggttttcagttccgcttcttttaaaccgccctgtttatcgacaggggtaaagaacaccggactttgccagctaatttcgcgtttaatgaattcgtagcgcggcacctgcgacaccgccgcacggttaaccagctccagccgggagaaaatcacctgggtggtggtggtgccgatatcgataccgacgctcaatagctggcgagtgttcacgattgtgcctccgcttcggttttagtcgcggtcgcgtcttcttttggcaccagcatcatcgccacgccaatcgccgttacgccgccgatcaacttgccgacaatcatcgggaagatcatggcgttcatgttggcagcggcgaagcctaagtggtcgcccagggcgaaagcagcggaaacggcgaaggcgcagttgatgactttgccgcgggtatccatctgcttcatcatgccgaacatcgggatgttgttggcaagcgttgccaccatgccggctgccgcgatgttgttcatattcagtactttaccgacgctcatcagcggtttttcaaaccagcgagtcagcagcagcaccatcggatacgcccctaacagaacgcaggagatagaaccgataacttcaatggcgcgcatcacctcaccgggtttatcgccaggggccataaagataggatccagaccggggatcagttcccagccaagcaggaatttcactaccgcagcggcaagaccgagggtgatcaatgcaacgaggaatttggcgaagatctggaagccgttgatcattttttccgggatgaatttcagccccagcgccaccagaatcgcaacaatgatcaccgggatcatgttcatcaggatcagggcgaaagtgaattccaccggctggccgttgatctgcacaccggagtacatagcaaccagaccaccagcgatacaaccaatcggaatggtcacaatgcccgccagcacgccgagcgccagataacgacggtcagaaggttcgataatgccgagcgccaccggaatggaaaacacaatcgttggccccatcatcgacccgagaattaacccagagtatagccacgcggctacgtcgccgcccgccagctctttggcgaggaagaagccgcccatatcgcacgccagcagtgttccggcgaacatcgatgggttagcgccgagcatttcgtaaaccggaataattaccggcccgagaacgtgagccagtaccggtgccagcgcggtcataccgaccatcgccaggcccagtgcgcccattgccataaagccttcttcgaactgaccgcctgatccttcgatacttttaccgaacttaccgaggaaacgagcagaaccgccgaactgcgacaggatcctgtctacggcagctatcagcataaagaacatcatgatgtacatgatgatttcgttaattcccatcgcctttactccctgttagttgttatttattggcggatgcggcgtaaacgccttatccgccctacatgtgcaatcccgtaggctggataagacgcggcaagcgtcgcatccggcaattgcaccgcgccactggcggatgcggcgtgaacgccttatccgccctacatgtgcaatcccgtaggctggataagatgcggcaagcgtcgcatccggcatttattgcgccgctgcgtacaggccgacaatctgctccaggctggcggtacgcgggttactgcgcagacaaatatcttccagcgcggcctgcgcccatgcgccgtaatgcgcagatgtcgcaccaacatcgcccagtcgtttaccaatcccaacttccgcaatcagctcacttaccgcgttaatagcgtcacgatcgtcggattttttagttcgcagtgcccgaccaatctgactaaagcgttcacgacaaaccatccggttaaattccatcaccgttggcagcaacatggcgttcgcgagaccgtgcggaatatgcagcgccgcgcccggctgatgcgccatcgcgtggcacaacccaagacccgcactggaaaacgccattcccgccatacatgaagccagcaacatgctctcgcgcgcggcaaggtcgtgaccgtagcccaccgctttcggcagcgatttgccaatcatcgcaatggcaccaatcgccagactgtcggtaaacggtgtagcgttcagggcgctgtatgcttcaatggcatgggttaacgcatcaatgccggtcatcgccgtgacatgcgacggcacaccttcggtcaatgcggcgtcgaggatcgccacatccggcatcagcgaggcatgggctaacacctgcttgcgcccgctcaccgcgtcgataatcaccgttacattggtggtttcagagccggttccggcggtagttggaatggcaatcagcggcaagcgcggttgcagaacgctggtttctgacatctctgccagcgtgctatccgggttcgtcaccagcaacgtcacggctttcgccgcatccagcaccgagccgccgccaaacgcgatcaccccatcacagcctgactcacgcaactgcgccacggctgcacacacgtcggtaatgcacggttcgcccaccggacatggccagagcgtcatggcgatacctttaacggtcaggctacgcgtcagcccggcggtcatccctgcctgatgcaaaaagctgtctgccatcacgaacagatgtttcagcccacgcgtttgcgcttgctgtccgcaactgctcaccgagcccggaccgcaaagcgtcaccggtggaacgctaaatgtttttacccgttgcagattcagggtatcgaacgcctgaaagagcgcggtctgcaattcattttgcatatagcccctccgctttctctcgcccactactggcgatcgccagcggggtcataaacaaactgtgctgcggtaaatgcacctgtaacgccgggaattgtttgcgaaacagttccgccacgcccggttgcatacaagagccgcccgccagccataaatcagtaatgccctgcccttcaatatgccgggcgacaatgtccgccattttttcgtacaccggtttcaccgcaggccaaatctcttcaccgtgaccgcgcttgtactgctccgcctcttccagcgaaatacggcgatttccggcgagagtcagagagatgtgatgtccgccggtggcttcatccgccgagtacgtcaccttgccctttttcacgatggcaatgccggtagtgccgccgccgatatccactacaccggcgttgtccagttgcagcagatccgcaactgcggttggctcatccagcacatggctcacttccagtccggcagattccagcacgttgatggaaatacgcgggtccgtacctggaggaaatgaagtcgccgcatggctaaaacgacgaccgaattgctgctcgagcgtgtcgagatggcgacgaacaatggtgacagcgccgaagaaatcccagacgatgccgtcgcgaaccacatcggcccagtcgaggcataccgccactggctgaccgtcgcggtcgacaaccatcgacaccacatcgcaggtgcccagatccacccccagccacagcggagattccgtcgcggcgggcgtctggttacacagcgttgccgccgtttgcagacgtggggtgagccattgttcgtcgtgcgccatctgttactccttaaacaatgcgaaacgcatcgactaatacacagcgacgcagacggacaaacgtacgcgcgctggttaccccttcaccggttggcgtggtgatggtcatggtggtccagccttccccgcccagccccagcccggcaatgcacggtccgttcttaacgaaaatgctggtatcaatagcattcgccatctggttcatgttttcgatgttgcgcgagtgcattgccgccgtgtggtggcaaccgccttccagtttcaccgctagcgcaatggcatccgccacgttggcgacgcgcacgacgggcaacaccggcatcatcagttcagtcacggcaaacggatgttctgcggtggtttccacaaacagcaggcgcgtttcttgcggaactttaaggccgattgccgccgcgattttgcctgcgtcgcgaccaacccagtcacggctgacggtgccttttccgcgctcgtcgatatttttcagcaacaccggttgcagctgctgcgcctgttctgcggtcagtttcaccgcgtgctggccttccatcagacgcatcagttcatcggctacgctatcaacaacaatcagtaccttttcgtcggcacaaatgatgttgttatcgaaagaagcgcctttgacgatggactgagcggcacgggcgaggtcggcggtttcatccaccactaccggcgggttgccagcgcctgcggcaatcagacgtttattggtgtgtttacgcgccgcttctactaccgcttcgccgccggttaccaccagcaggccgatacccggaaacttgaacaagcgttgcgcggtttcgatatccggatttgccacagtaaccagtaagttttccggcccacctgcggcaacaatcgcctggttgagcagcgtaatcgcccgctgggagacttttttcgccgccggatgcggggcaaaaatgacgctgttgcccgcggcaatcaggctgatggcgttgttaattacggttgccgccgggttagtggaaggcgtcaccgaagccaccacgccccagggtgcgttttcaattagggtcaggccgttgtcgccagtcagcacttgcggagagaggcactcaacgcctggtgtgccgcgcgcctgagcgacgttttttgcaaatttatcttcaacgcgccccatgccggtttcactgacggcaagttccgctaaatctctggcgtgtttttcgcctgcttcacgaatggcagcaatggctaactggcgcattgccacgctttttaacccttgctgggcgactttggctgccgcaacggcgtcatccagggacgcgaaaacgcccatctcatgaacggcggcggacggcgtgtcactgctttgcattttcagcagtaccgctttcaccacctgttcaatatcctgttgattcatgatgttctgccttatttgtggaaaattacctgaccgccagacaccacctcatcgacaatgccaatcacgcacagatcgaccggtgacgtttcgcttttatgcgcctggcgggcggaactgccactcaccagtaacacccactccccggttcccgcgccaatattgtcgatggcgacggcgcattgcccgtcaggattaccttgtggatcaatcatttccaccatcagcaatttgtcatgcgccagtccgtgatggcgtacggtacaaacaatttgtccagtgacgactgccagtttcatacccgcctccgtggcgtatttcaggtaaaagctccccctaccctccgcagaaggtaaaatgaaaaaggagagagcgtgacgcccgaatcgacgtcacacagggtgattacaggttgctgctatcgcctttcaggccgatcgggaagacttcttccaggtcgccgtgcggacgcgggataacgtgtacagataccagctcgccgatacgctgtgccgctgcggcacctgcatcggtcgcggctttacaggctgcaacatcaccacgaaccatggcagtacacaggccgccgccaatctgcttaacaccaaccagcttgacgcgcgcagctttcaccatcgcgtcagaagcctcaatcagtgcaaccaggccccgggtttcgatcattcctaatgcttccattgtgctttcctctttatcagggtccagaacgggaccgttcattcaaccagtgtttgtaaactgctttcgcggttcacttctgtctgacgcggcacagctgccaccagcgccagctcgataatttcctgcacgctacaaccacgagagagatcgtgcatcggcgcggcaagtccttgtatcagtggcccgacggcacgatatccgccgagtcgttgtgcgattttgtaaccaatatttccggcttccagcgacggaaaaaccatcacattggccttgccctgtagcgggctggcaggcgctttttgcgccgccacttccggcacgaaggcggcgtcaaactgtaactcgccatccaccaccagctttggtgcgcgctcacggacgatttctgtcgcctgctggacgttagcaacacaggggtgacgggcgctaccattgctggaaaacgacagcatcgccacgcgcggctcttctccggtgatggcgcgccaggtttcggcactggcaagcgcgatatccgccagctgcgccgccgtcggctgtggcaccacgctgcaatcggcaaagcccaacgccgggccgctgtactgtggcaacatcaggaaaatggaagagagcgttttacagcctggctgcaagccgataatgcgtaatccggcacgcagcacatttgccgtggaagagaggttgcccgcgatacagacatccgctttaccggcgctgaccattgctgcggcgaacatcagagggtcggtaagtttttccagcgcatccggcggcgttttttcgcccgcgcgggccagccagcgatgagcaaattcttcccgcattgcgaggttgccatgcggatcaatcacctgtagcccgtccatcgccacgccgtgactgagcgcaaactgacgaagttcaaacggattggcgaccagaatgggcgttgccagaccttgttgatgtaaatattgcgcggctttcagcacacgttggtctaacgcatccggaaaaaccactctggcgggcgctcgcaacgccagttcacgacaacgttcaataatcattgcgtttcccccagtcgttgttggatctgcttcaccgttagcggctgcttcgttacgctcaggatcatcatcacgtagaccgtgctcgaaaggcggttcagcgcctgcaaaatgtccgggcgtaatacttcaaagctgcgggtgataaagacctgcgccgctacggtttcggtttcccgcactttggtgcgtagcagattgagcaacgcagcatcgcgcccgtggctggcttccggcaccagatgatcgtggtcgagatagcgcagcggctgatgagaaagccgatgcagatcttcgtcagaaagcccgacaatcgcctggcagcccagcggttcccccagcgcatcggcgcgcataatgttgccaagacgcgaacggatatccgccagccacggctgccacggttccgccagttcaatttgcagccacactgccagcgcaatggtgctgtcgagaaccgcgcgaaaacccagacgcggatcgcttttggcgaccattttttccgccgacaggtgagtcagcgtatccggcttttttgccaccggctggcgacacagttcgcagcacgcctgcggatgttcatcgctactggtcagcccatgaacgggctgcggctgctgctgttcatcgtcaacaaacaggcggccctgctcgtcaataaacttgatgcgcagatggcggctttccagcaactcccgggcagagggcgtcaggcgactgtccgcagggagatggatctctgcgccttcgctgagcgtatggttcgctcttagccatgcttcggtgatgaaatctttcatagggattgccagttagccggccaggcgacatacaggaatttcacgctggatgtcgtaccaaattcgatgctggagcctttcgggataaacatcacgtcgcctgctttggcgatcatggtttggccttcgtggcgaacatgcagctccccttccagcaccatgtcgatttcgtcgtagttcagggtccacgggaagaatgcgttctcccactgcataaaaccggcggccatgctgctgccgtcgtctccggtcacaagatcagtcaagcccacgcaatgcggctctgcgccgtcgaaacgaccaaacttgacgctactgccatcaatcactttgatgccgcctttgccggtcaccgatttgaagctcggctgcattgcgccctgctccagcgactgtttttccttcatcactttttccatcagctgtgcgaccaggctttcggtaaactggccttccggcagctgggcaatgatggtttcgcggatgcgctggctttcggttttgtcggctggcacgctggcgggcacggacgccgttaccgggatcgattcatcacattcggtgatggtaaaacccagtagatccgccacttcacgggcttccggggtaataatgctggcgcgcagaaccacggacattgcctgttcgccgcgcgcgtgtgcttcacgaatatcattcgctgtgatgagttttttcacctgcttcctcctgtttggtgagagatgccagataatccaccagttgctgcacgctttgcgggtcgtggctgtttagctcgaacatcggctcttcgaaacccgtctcaagcaataactttcgcgttgcggcgacgtcagcatctggcatgtccgttttactgatgacggcgatttgccgtttgctgacgccaatatccagcaacccggcaggcaaccgactttccgggtcatttgcgccatggacatagatcagcatgtctacatcctgtagcgtggtaattaaggcgtgataccagcggggatggttaaaatattcacccggcgtatcaatatcgcccttatcattaaattccacggcctgtgtttttctggcgagggtataattcccctgcaacgcattaaataacgttgtttttcctgccccgacgctacccacaaacgcaattcgtttcatgaatgcctcgtattaacttttggtcatttcacaaagcgtataatttaataagcgacctaaaccgctgacggtttgtgataacgcttcttctactgcgcccaccgagccataaatcaccaatgcaccgctgaatcggtcgagaaaaccgatatgcacatcagcggctttcagcgctaaatcaccggcgatcatcgccgtttcgccgggagttagcgtcataatgccaattgcgcccgcatccggaacgccgattttcttcgccagttcctcaccgggatgcgcgatgagatgcgccagtgtgacctgtttgccgggcacaaattcctgaatgatgcgttctttatccatgagtcgccgcctgtgaaaaactttcgtgtatcgtgacaatttttcgtcagagtaaataacaaaattcggcaagcgcgtttaaaaggtgaggtagatcactaagaatggagagatattcgctgtggtgcataaactttcatatgcaacgcatgaatataaataaaataatatcgagatattatatagactgcttttttttattattcgcaaactcagtaataagctttactaatatattgcagctaaactgcttaccctgaatattcagggtaagcgtgagagttaaaaaaaattacagcggttgggtttgcgcttctaccacggccagcgccaccatgttgacgatacgacgcaccgatgcgatcggcgttaacacgtgaaccggtttcgccacacccatcagcaccgggccgacagtcacaccttccgagctggaaacacgcagtaagttgtaactaatgcgggcagcttccatgttcggcatcaccagaatattggcggaacctttcaaagagctgtccggcatacggtcgttgcgaatcgcttccaccagcgctgcatcgccgtgcatttcaccatcaatcatcagttctggtgcacgttccctgaccagttccagcgcctgacgcattttgctcgacgacgggcagtcagaagaaccaaagttggagtgcgacaacaaagcaacgcgcggctcaataccaaaacgacggacagtttctgccgccatcaaggtgatctccgccagctcttctgcatccggttcatcattaacatatgtatcggcaataaaggtgttaccactcggcagcagcagcgcgttcatggcacctgcggtgtgaacgccatcgcgataaccaaagacatttttcaccacgctaaaatgttcatgataatcacccaccgtaccgcaaatcattgcatcggcttccccacgctgaaccatgatcgcgccgatcactgtcgggttactgatcagcgcccgctgcgcctgttcctgagtgacgccgcgacgcttcatgatctggaagtattcggtccagtactctttaaagcgcggatcggattcgttattgacgatctcaaaatcaacgcccgctttgatctgcaagcccagtttctgaatgcgcatttcgatcacgttcggacgaccgataaggatcggtttcgccagtcccagcgttaccagttcctgagtggcatgcagaacgcgcgcctcttccccttccggcagaacaacgcgcttcggcgctttgcgagcctgggagaaaatcggcttcataaacaggttggttttgtaaacgaactcagtcagcttgtcgatgtagacgtcgaaatcagcaatcggacgagtcgccacgcccgactccatcgcggctttagcgaccgcaggagcgatcttaacgatcaagcgcggatcaaacggttttggaatgatgtattccggaccaaagctcagatcctgatcgccatacgctgaagccaccacttcgctctgttccgcatgggcgagttctgcaatcgcacgtaccgccgccagtttcatctcttcgttgatggcggttgcgccaacgtccagcgcgccacggaagatgaacgggaagcacaggacgttgttcacctggttcggatagtcagaacgaccggtgcaaatgatggcatccggacgcacttctttcgccagcggcggcagaatttccggttccgggttcgccagcgccaggatcattggcgcacgagccattttcttcaccatttcctgggtcagcactttcgggccggaacagcccaggaaaatatccgcgccttcaatcacatcatcgagggtacgtttgccgtcatccaccaccgcatatgcggctttggtttccgccatgtttggctcacggccctgatagataacgccttttgaatcgcaaaccacgatgttatgtttttgcagacccagcgctaccagcaggttcatacaggcgattgctgcggcacccgcgccggaaaccaccatccgcacgtcggagatgtttttctccaccacgcgcaagccgttgaggatggcggcagtgctgataattgccgtgccgtgctgatcgtcgtggaataccggaatattcatccgctcgcgcagtttctgttcaatatagaaacattctggcgctttaatgtcttcgaggttgatgccgccgaaggttggttcgagcgcggcgacaacttcaataaatttgtccgggtcgagttcgtcaacttcaatgtcaaatacatcaatcccggcgaatttcttaaacagaacgcccttgccttccatcaccggtttgcctgccagcgcgccaatgttgcctaaccccagcaccgccgtaccgttagagatcaccgccaccaggttacctcgggcggtatatttgtaggcttttaacgggtctttttcgatttcaagacaaggtgcggcaacgcctggtgagtaggccagcgccagatcgcgctgtgttgccagaggcttggttggagaaacctggattttccctggaactggaaattcatggaaatcaagtgcactttgttttaactggtcatccatttggttgttcctttcacgtaacgttcacaaataaagtgtgtgggcaacagcccctgcccacaacgtggcgcacattattaccctgccggagtctacagactttgagcaagtccaaactctcaccattaatataatgttttggtaataatcctataacactgatgttacctgcttaatccagcaataccatgcctgtctgctatgcttttttgatgcgtttagcgaaatttctcagaagtgtgaattaacgcactcatctaacactttacttttcaaggagtatttcctatgaacgagttagacggcatcaaacagttcaccactgtcgtggcagacagcggcgatattgagtccattcgccattatcatccccaggatgccaccaccaatccttcgctgttactcaaagctgccggattatcacaatatgagcatttaatagacgatgctatcgcctggggtaaaaaaaatggcaagacccaggaacaacaggtggtcgcagcgtgtgacaaactggcggtcaatttcggtgctgaaatcctcaaaatcgtacccggtcgcgtgtcaacagaagttgatgcacgcctctcttttgataaagaaaagagtattgagaaggcgcgccatctggtggacttgtatcagcaacaaggcgttgagaaatcacgcattctgatcaagctggcttcgacctgggaaggaattcgcgcggcagaagagctggaaaaagaaggtattaactgcaacctgacgctgctgttttcttttgcacaggcacgggcctgtgcggaagcaggcgtttttctgatttcgccgtttgtcgggcgtatttatgactggtatcaggcacgcaagccgatggacccgtatgtggtggaagaagatccgggcgttaaatcggtgcgcaatatctacgactactataagcaacaccactatgaaaccattgtgatgggcgcgagcttccgtcgcaccgaacaaatcctcgccttaaccggctgcgatcgactgactatcgcaccgaatttactgaaggagctgcaggaaaaagtttcgccagtggtacgtaaattaatcccaccttctcagacgttcccacgcccagctcccatgagcgaagcggagttccgttgggagcacaatcaggatgcgatggcggtagaaaaactgtctgaaggcattcgtctgttcgccgttgatcaacgcaaactggaagatcttcttgccgccaaactataaaccagccacggagtgttatatgtcccgaaaagaccttgccaatgcgattcgcgcactcagtatggatgcggtacaaaaagccaactctggtcatcccggcgcgccgatgggcatggctgatattgccgaagtgctgtggaacgattttcttaaacataaccctaccgacccaacctggtatgatcgcgaccgctttattctttccaacggtcacgcgtcgatgctgctctacagtttgctacatctgaccggttacgacctgccgctggaagaactgaagaacttccgtcagttgcattcgaaaaccccaggccacccggagattggctatacgccaggcgttgaaaccaccaccggcccgcttggacaaggtttggcgaacgccgtcgggctggcgatagcagagcgtacactggcggcgcagtttaaccagccagaccatgagatcgtcgatcacttcacctatgtgtttatgggcgacggctgcctgatggaaggtatttcccacgaagtctgttcgctggcaggcacgctgggactgggcaagctgattggtttttacgatcacaacggtatttccatcgacggtgaaacagaaggctggtttaccgacgatacggcaaaacgttttgaagcctatcactggcatgtgatccatgaaatcgacggtcacgatccgcaggcggtgaaggaagcgatccttgaagcgcaaagcgtgaaagataagccgtcgctgattatctgccgtacggtgattggctttggttcgccgaataaagcaggtaaggaagaggcgcacggcgcaccactgggggaagaagaagtggcgctggcacggcaaaaactgggctggcaccatccgccatttgagatccctaaagagatttatcacgcctgggatgcccgtgaaaaaggcgaaaaagcgcagcagagctggaatgagaagtttgccgcctataaaaaggctcatccgcaactggcagaagagtttacccgacggatgagcggtggtttaccgaaggactgggagaaaacgactcagaaatatatcaatgagttacaggcaaatccggcgaaaatcgctacccgtaaggcttcgcaaaatacgcttaacgcttacgggccgatgctgcctgagttgctcggcggttcggcggatctggctcccagcaacctgaccatctggaaaggttctgtttcgctgaaggaagatccagcgggcaactacattcactacggggtgcgtgaatttggcatgaccgctatcgccaacggcatcgcgcaccacggcggctttgtgccgtataccgcgacgttcctgatgtttgttgaatacgcccgtaacgccgcgcggatggcggcactgatgaaagcgcggcagattatggtttatacccacgactcaattggcctgggcgaagatggtccgacgcaccaggctgttgagcaactggccagcctgcgcttaacgccaaatttcagcacctggcgaccgtgcgatcaggtggaagcggcggtgggctggaagctggcggttgagcgccacaacggaccgacggcactgatcctctcaaggcagaatctggcccaggtggaacgtacgccggatcaggttaaagagattgctcgtggcggttatgtgctgaaagacagcggcggtaagccagatattattctgattgccaccggttcagagatggaaattaccctgcaagcggcagagaaattagcaggagaaggtcgcaatgtacgcgtagtttccctgccctcgaccgatattttcgacgcccaggatgaggaatatcgggagtcggtgttgccttctaacgttgcggctcgcgtggcggtggaagcaggtattgccgattactggtacaagtatgttggtctgaaaggggcaattgtcgggatgacgggttacggggaatctgctccggcggataagctgttcccgttctttggctttaccgccgagaatattgtggcaaaagcgcataaggtgctgggagtgaaaggtgcctgatggtgattgccggatgctgattgccggatgcgacgctgacgcgtcttatccggcctacagcgtcttatccggcctacatgtcccgccattttgtttaacgggtgatccacaacgtgggccaggcgtctggcccatgccagttatcgcaggtgggttctgcggcgtaacgcaccaggcgaaaacgctgaccgtcaaagcgccagcgcgcctgaatgccacaatcgcttaatccgcgccctttcgctaaggtcaccagttcacgcgatttctcatcaaatgttgcgttcatcagttccagttcattcgtctcctgaccgttgttgaacggcaaacgcaaccgaaccgggcgcgaagctagtggctttttacgcgacacaatccatgccaaatcaatggtgttataggcccctgcctcacagctaatcatcatcagcgctttatcatcagtcagcgcagtgacattcacctcacgacgcaatggatcaagcgagcagcgcagaccattcatccgccagtttccataatccagcaaatcgttgcgttcttcgagtgagagtggcgtcggcgttgggttaaccaccgcgacctctttcagcgcaggcgcgggcggtacgctgagcggcggttcgtcccctttcttgatccacgcggtttcactgccaacgcgcttttgctgagcatcaataaacaacaacgctgcttttaagccactcagagaaatggtctgatcgccatcgcgtaaggtgattgccttcccttcctgaatcatctgcaaaaacgcggtgatggttgccgtatcatcggttactaataaccatggtgaaatccgccacttgtcaccacttaacgccaacggctcgccatctaacagcagccgtggcgctatctccccttctgacgcctccggcgacttcaatccgccgcgctcaatacgtaaaacggcatcggtatgcgccccggcgctgcggctcagggtcatcaccagtccattatgatcgcccgtattacgcgccacgcagaaattttggttattacaggtgacctgccagtcggaaaacgcccgttgcgctggtgccgcccacaccaaagacgtcggcaacaaagcgaaaaaaaagagaaggaaaatgcgatagcgcatggacggtacgaccccagaagttcaaacaaacagcacaagtcgtatcttcgttgcgcaggtagcgcggctcaatcggatttgtcggattgagccaataataaacaacgaaatattattgttatttttcagtccattaaatgtgacgtttgcaaatagttaagcaataacaccgtcttaccgtcacgtatctcgccggttttgatcatctccagcgcctggctgaacggcagctcgagcacttcaatatcttcatcttcgacaccgccaccggcgttagcgcgctgattgtcactgtattcggcgataaaaaagtggattagctcagtcacaccgcctggcgacatatacagttcaaataatttgcgcacttcacccacttcatagcccgtctcttcaatcgcttctttgcgaatacacacttccggttcgtcgttatccagcagcccggcgcagctttcaatcagctgcccgctttcattgccattaacccaggtagcgacacggaactgacgaatcagaaccacggtctttttcttcgtgttgtacaggaggatcgtcgcaccattgccgcgatcgtacacttcacgtttatggcggataacttcgccgtctttgcgcgtgagatcgtaagtaatgttgtgcagggtgaaatagttatcggagagaattttgtctttaatgagggtgatttgttgcgtcataccgactccacagcgcgaaatgaacaattatcttacgctgtgaagtcgggtttgtctgcgcaggctatcagtgagatttgactgattttacccccagccagtcaataatcccctgtgccgcatgacgtccttctgccattgcggtaaccaccagatccgcaccacgcacggcgtcaccaccagcgaagattttcggattggtggtctggtaacggtactggctttccacatccgcgatgatgcggccccatttgtctaccgttacaccgtgcgactccagccacggcatcccgtgcggattgaagccaaacgccataatcaccgcgtcggctggcatgacaaattcactgccttccaccggcactggacgccgacgcccctgggcatccggctctccaagacgcgtgcgcaggaaacgaatcccgcagacgtgaccttgttcattcagctcaagcgccaccggctggacgttaaattcgaagttggccccctcttcgcgggcgttcttcacttctttcttcgagcctggcatgttagcttcatcacgacgataagcgcaggtgacgttactcgcgccgtggcgcagtgcggtacgcacacagtccatcgcggtgtcgccgccgcccagtaccacgacgttaagtccggcggtattgataaacggctcttccggtagctcttcgagccccatcacctgtttagtgttggcaatgaggaacggcagcgcgtcataaacgcccggcgcatcttcattgggtaaacccgctttcatggaacggtaagtgcctacgccaacgaagaccgcgtcgtattgttccaaaagcgaatccaaagagacatctttacccacttcacaattgagttcgaagtgaatccccatcgcgctgaagatttcccgacggcgtgccagcagggatttatccagtttgaaagaaggaatgccgaaagtgagcaagccaccgatttctggatggcgatcgtacaccgtcacccccacgccattgcgggtcagaacatccgcacaggccagccctgccggacctgcaccgataatcgccacccgcttgtccactttggtgacatggcttaagtcaggacgccaacctttcgccaacgcctgatctgaaatgtagcgttcaatgttgccgatagttaccgcgccgtgctcatcgcgaatagtacaggcaccttcacacaaacggtcttgcggacaaacgcgtccggtaatttccggcagggtgttggtctggtgagaaagctcgacggcggcgtcgatgtttccggctttcaccagttcaatccactgcggtatatggttatgcagcgggcaggtccattcacaaacgctgtgctcgccgcacttaaggcagcgcgaggcttcccgttgtgcctggtcggcgcgaaatggcagataaatttcatcaaaaccggttttgcgcgcttcaatcgccagtttatccggctcgccacgcgcgggcgttgcctgcatttgttcgactttactcattaccggcatttcttgcgccgcggtactggcatgccacggttgatgttcctgacgcgcggtgcgcaagcggcgggatttcgccatgccggagagtgcgacgtcagtgaccagttgcagcgcgtccgccgggcaattctcaacacaggcaggaccgttttcgcgccccgcacaaaggtcgcatttatgcgccgtggcttttacttttcctgccgcgacgggtgtcaggacgatttgcatcgtaccaaaaggacaggccaccacgcaggatttacagccaatacacttttgctgattgacctgaatgctgtcatcaacgtggctgattgcgccattagggcagctacgggcgcagggcgcatcttcacaatggtgacaggtcactgcactacgttgctgttgatgtttgataaccgtaattcggggatgaaaatggtgttggctcaggacatgttgctcatcattgtgagccatgacacaggcgatttcacaagcatgacaacccagacattgctgactgttggccataataaaacgattcataacgaccttcttttttggttgtaaaaaccttattctttatatgagtgttgttattacccgacttacaggggaatcggcaatgttcatgtgcccagaataagtaactatttcgctataaactgtggcagatcaaataatcccatcactgactaaattgcgtttcagcgaactggaacattaatgattttttgtggagaagacgcgtgtgattgttaaacgacccgtctcggccagtctggcccgggcctttttttacattgtgctgctgtcgattctttccacgggtatcgctctgctaactctggcgagcagtttgcgcgacgctgaggctatcaatattgccggatcgctgcgtatgcagagttaccgcctgggctacgacttgcaaagtggcagtccacaactcaatgcacatcgccagttatttcagcaggcactgcattcaccggtattaaccaacctcaacgtctggtatgtgccagaagcagtaaaaactcgctatgcgcatctgaatgccaactggctggagatgaataatcggctcagcaagggcgatttgccgtggtatcaggccaatattaataattatgttaatcagatagacctgttcgtactggctttacagcactacgctgaacgcaaaatgctgctggtggtggcgatttccctggctggcggcatcggtattttcacgctggtcttttttactttgcgccgcatacgccatcaggtggttgccccgctgaatcagctggttaccgccagtcagcgtattgaacacgggcagttcgactcgccgccgctggataccaacctgccgaatgagcttggtctgcttgcaaaaacctttaaccagatgtcgagcgagctgcataaattgtaccgttcgctggaagcgtcagtagaagaaaagacccgcgatctccacgaggccaagcgtcgtctggaggtgttgtatcagtgttcgcaggcgctgaacactagccagattgatgtgcattgtttccgccatattttgcagattgttcgcgacaatgaagcggctgaatatctggagttaaatgtcggtgaaaactggcggattagcgaagggcaaccaaacccggaattgccgatgcagattttaccggtgacaatgcaagagacggtttacggcgaactgcactggcaaaatagtcacgtttcatcatcagaaccgctgcttaacagcgtttcgtcgatgctgggacgcggtttgtactttaatcaggcgcagaagcattttcagcaattattgttgatggaagaacgtgcgaccatcgcccgcgaattgcacgactcgctggctcaggtactttcttacttacgtatccagttgacgttactgaagcgttcgataccggaagataacgccaccgcacaaagtatcatggccgatttttcccaggcgttgaatgatgcttatcggcagttacgcgagctgttgactactttccgcctgacgctgcagcaggcggatctcccctccgcattgagggaaatgctggatacgttacaaaatcaaaccagcgccaaactgaccctcgactgccgtctgccaaccctggcactggatgcgcaaatgcaggtgcatttgttgcaaattattcgcgaagcggtgctgaatgcgatgaagcacgccaacgccagcgaaatcgccgtcagttgcgtcaccgcgccggacggcaatcacacggtttatatccgtgataacgggattggtatcggtgaaccgaaagaacccgaaggtcattatggtctgaatatcatgcgcgaacgcgcggaacggctaggtgggacgctgactttttcacaaccttccggcggcggcacgttagtgagtattagctttcgctctgcggagggtgaggaaagtcagttaatgtaatgcctcctactgaccaaagaatacttgcacttaaggttcagtataaaagggcatgataatttacattaactcctttttttctccacgattggctcgtaccttgccgctacagtgaagcaagtcaagcctacaacgatacgcagaaacacgaggtcctcttttaatggcgaatttctttattgatcgccccatttttgcctgggtgctggcaatcctgttgtgtctgacaggtaccctggcgattttttcattgcccgttgaacaataccccgatctcgcgccaccgaatgtgcgagtgaccgctaactatcccggcgcatcggcccagacgctggaaaacaccgtgacccaggttatcgagcaaaatatgaccggcctcgataatctcatgtatatgtcatctcagagcagtggcaccggtcaggcatctgtcactttaagttttaaagcaggcaccgatccggacgaagccgtgcagcaagtacaaaaccagctgcaatcagccatgcgaaagttaccgcaggcggtgcaaaatcagggcgtgacggtgcgtaaaaccggcgataccaacattctgaccattgccttcgtctctaccgatggttcgatggataaacaggatattgctgattatgttgccagtaatattcaggacccgttaagccgcgtgaatggcgtcggggatatcgatgcctatggttcgcaatattccatgcgtatctggctggacccggcgaaactcaacagtttccagatgacggctaaagatgtcactgatgccattgagtcacagaacgcgcagattgcggttgggcaacttggtggtacaccttccgtcgataagcaggcgctcaacgccaccattaacgcccagtcactgctgcaaacaccagaacagttccgcgatatcaccttgcgggtcaatcaggacggctcagaggtaaggctgggcgatgtcgccaccgtcgaaatgggggcggagaaatacgattatcttagccgcttcaatggtaagccagcctccgggctgggggtaaaactggcctccggcgctaacgaaatggcgacagcggagctggtgctcaatcgtctcgacgagctggcgcagtatttcccgcatggactggaatacaaggtggcgtatgaaaccacctcgtttgttaaagcctccattgaagacgtggtgaaaacgctgctggaagctatcgctctggttttcctcgttatgtatctgttcctgcaaaacttccgcgccacgctgatacccactatcgccgtgccggtggtgttgatgggaaccttctccgtactttacgccttcggttacagcgtcaacaccttaaccatgttcgcgatggtgctggcgatcggtctgctggtggatgacgccatcgtggtggtggaaaacgtcgaacgtattatgagtgaggaaggactcactcctcgcgaagccacacgtaaatcgatggggcagatccagggggcactggtcgggattgcgatggttctttcggcggtatttgtaccaatggccttcttcggcggcaccaccggtgccatctatcgccagttctctattaccattgttgcggcgatggtgctgtcagtactggtagcgatgatcctcactccggctctgtgtgccacactacttaagccactgaaaaaaggtgagcatcatgggcaaaaaggcttttttgcctggtttaaccagatgtttaaccgcaacgccgaacgctacgaaaaaggggtggcgaaaattctccaccgtagcctgcgctggattgtgatttatgtcctgctgcttggcggcatggtgttcctgttcctgcgtttgccgacgtcgttcttaccgctggaagaccgtggcatgtttactacctcggtacagttgcccagcggttcaacgcaacaacagaccctgaaagtcgttgagcaaatcgagaaatactacttcacccatgaaaaagacaacatcatgtcggtgtttgccaccgttggttctggccctgggggtaacgggcaaaacgtggcgcgaatgtttatccgcctgaaagactggagcgaacgcgacagtaagaccggcacctcgtttgccattatcgagcgtgcaacgaaggcgtttaaccaaattaaagaagctcgcgttatcgccagcagcccgccagcaattagcggtcttggtagttctgcaggttttgatatggagttgcaggaccacgctggagcgggtcacgatgcgctgatggcagcacgtaatcagttgctggcgctggcggcggaaaacccggagctaacccgtgtgcgccataacggcctcgacgacagtccgcagttgcagattgatatcgaccagcgtaaagctcaggcgctgggcgttgctatcgacgatattaacgacacactgcaaaccgcctggggttcgagctatgtgaatgactttatggatcgcggtcgcgtgaagaaagtctatgtgcaggcagctgcgccgtatcgcatgctgccagatgacatcaatctctggtatgtccgaaataaagatggcggcatggtgcccttctctgctttcgcgacctcacgctgggaaacaggctcgccgcgtctggaacgctataacggttattctgcggttgagattgttggggaagccgcaccgggggtcagtaccggtacggcgatggatattatggaatcgttagtgaagcagctgccaaacggctttggtctggagtggacggcgatgtcgtatcaggagcggctttccggcgcgcaggctccggcgctgtacgccatttccttgctggtggtattcctgtgtctggctgcgttgtatgaaagctggtcggtgccgttctcggtaatgctggtcgtgccgctgggggtaatcggcgcgctgctggcaacctggatgcgcgggctggaaaacgacgtttacttccaggtgggcctgttaacggtcattggtttatcggcgaaaaacgccatcctgatcgtcgagtttgctaacgagatgaaccaaaaaggccacgacctgtttgaagcgacgctccacgcctgccgtcagcgtttacgcccgattctgatgacctcgctggcatttatcttcggcgtattgccaatggcaaccagcacgggtgccggttccggtggtcagcatgcggtgggtactggcgtaatgggcgggatgatttcggccactattctggctatttacttcgtgccgctgttctttgtgctggtgcgccgccgcttcccgctgaagccgcgcccggaataagcaataaaaaaggcgacatgccaatgtgtcgcctttttcaactttccgattaagaacctgctcagcgggttcttgctgtttgtactttgtctcaggaattacttacgaagcataacttcgataaagtctttccagttccccagttcacgttcaatcataacaacctctcttataattatgggtattctacggaaacaatataccgtggtgaagctaatttactcgattgctgcgatgactacctccgggggacaaatcttatgtaaatactatggtcctgcggtgatgatttgtatgtgatacacagcaacatttcgagatattcatacggcatctaatactgatttaattctggttaaaatacagacagataacaagatgaatattcttaatgtttacgttaaaaatgtttaatattatttaatagttgttaatttgaatacttcgataatgttatatttcctgataatcatttgcaggcaaaatgttttcacccttaaatgagtatttattctcataaatcgaaaaaggattcattatggttacactttacggtatcaaaaattgtgacaccattaaaaaggctcgccgttggctggaagccaataacatcgactatcgttttcatgattaccgcgtcgatgggctggacagcgaattattgaacgattttatcaacgaattaggctgggaagcgttactcaacacccgtggtacaacctggcgtaaactggacgaaaccacccgcaataaaatcaccgatgcggcctctgcggcggcattaatgactgaaatgcctgcaattatcaaacgtccattgctctgcgtgcccggtaagcctatgctgctgggtttcagtgattccagttatcagcaatttttccatgaggtgtagtctatgtcgtgcccggttattgagctgacacaacagcttattcgccgcccttccctgagtcctgatgatgcaggatgccaggctttgttgattgaacgtttgcaggcgatcggttttaccgttgaacgcatggactttgccgatacgcagaatttttgggcatggcgtgggcagggtgaaacgttagcctttgccgggcataccgacgtggtgccgcctggcgacgccgatcgttggatcaatcccccgtttgaacccaccattcgtgacggcatgttattcgggcgcggtgcggcagatatgaaaggctcgctggcggcgatggtggtggcggcagaacgttttgtcgcacaacatcccaaccatacggggcgactggcatttctgatcacctctgatgaagaagccagtgcccacaacggtacggtaaaagtcgtcgaagcgttaatggcacgtaatgagcgtctcgattactgcctggttggcgaaccgtcgagtatcgaagtggtaggtgatgtggtgaaaaatggtcgtcgcggatcattaacctgcaaccttaccattcatggcgttcaggggcatgttgcctacccacatctggctgacaatccggtacatcgcgcagcacctttccttaatgaattagtggctattgagtgggatcagggcaatgaattcttcccggcgaccagtatgcagattgccaatattcaggcgggaacgggcagtaacaacgttattccgggtgaactgtttgtgcagtttaacttccgcttcagcaccgaactgactgatgagatgatcaaagcgcaggtgcttgccctgcttgaaaaacatcaactgcgctatacggtggattggtggctttccgggcagccatttttgaccgcgcgcggtaaactggtggatgcggtcgttaacgcggttgagcactataatgaaattaaaccgcagctactgaccacaggcggaacgtccgacgggcgctttattgcccgcatgggggcgcaggtggtggaactcgggccggtcaatgccactattcataaaattaatgaatgtgtgaacgctgccgacctgcagctacttgcccgtatgtatcaacgtatcatggaacagctcgtcgcctgatgagtggttctgcaagaggaaataagcatggactggctggctaaatattggtggattctggtgattgtctttttggtaggcgtcctgctgaacgtgattaaagatctcaagcgcgtcgaccataagaaatttctcgccaacaagccggagcttcccccgcatcgtgatttcaacgataagtgggacgatgacgacgactggccgaaaaaggatcaaccgaagaagtaagctgagtgctcaaccgtaggccggataaggcgttaacgccgcatccggcaatggtgaacgatgcctgatgcgacgctcacgcgtcttatcaggccaggtaatctgtcttttacatcatttcaatcacatcatcatcgccaggcttaccgccacttagcgcttcgtcgaaataatgtttcggaatggtataacgcaagtgatccagggcaaattgcatactgcgattgtcgatcgcatggcctaaatcctccacgatatccagcgtcacgtcaccaccggcactgattaacgcttcctgcgccgcaaccgcatgcgccagatcgataaccggatcttcaccgccatgaatcaggtgaattgtcgtggctgtagacgcagtttccggcaggctcgcatagcgtccgttaaaagcaatgacgcgtgaagcaaggcccggttcggctttaatgctctccagcaccataatcgcgccttgagagaaaccgatgagcgccgtggcgttagcccctactccgctctgtttctgccagtagcgcaccgtttcaataaacgtcggcatgatcgcatccacacgcgcctggcgattatcttccgtaataccctgcaccgaaaaccactgacgccccgccggattaccgctcggctccgcgccaccgacactcaccaccagcgcatcaggaaacagcggtgcaaaccagttgcctatttcccccattgccaccgggttatccccgacaccgtggaaaagcagtaacaactgttgcgcaggtttatccgggctttgaacaacaaaatggtcatgtttcatggcgaactccttaactgatgtcattaattttacgccgctgactcacaatgaccatgagataaaattgaaggagtcagtgaaataattgccattgcgttatgcgatcgcgcagacgctcagtgcgaacatcattaagtgcgaacagcgcctgcgcggcctcttcccgctgacggaccagtaacatcttgcggcctgaaagtttaagtgtggtacataactgcgcatcactggcgtttttctgtaaacgcccacgcagcgccggtaatgccagttcactggtttgtaacagacgcaataagcaacctaacgacgttaatagcggacgatgagcgaaagcaaaaccggccagttcaagccagtcgtcgtcagaaaggacggcatcgtttagtggatcaacaggaagcgtttcgccattccactgcgcgagagcttgcgcatcgcgacgtaaacggtaatgctcacgttcagccagctgtttacccgcatcactcatcggtaacagcgccatcgccgtatagcaaccgctgctggcttcccgatgattacccatccgcaccagcacaaaaccgcagcgttgccagaaacgccataactccccggtgtaaccaaaactcaccgaaagatagtcgaggtcttgcgtatattgcaaagcaccagcaataagttgccgccctgtgccttcccgctgacgagccggatgaactgctatccggctgacccgccgtccacgcaatgtcgccgccagtggattgttgccgtgcgccgccagcgactgggccaccagattaccccgcgggcgacgaaaacctgcccataccgcctgactgagttgttgagataatccaccctcatccaccagccacagcgccccggcaatctcgttttcgccagccgcctgtaaaaaatgttgccctggtgcatccatcatccggcgtaaatccagcggcgaagtccgatagtgcgcaccagacaagagctgataaacctttaacggcgtttctggatcgctttgccataacgtctgttcaaatgcggaaatgacaatattgccttgtggtgtatgggtgaagttttcatcgtcaaaaaccagtgcctcgctgaccattttttccagcgggcatccctgcgcccagcggatcggctgttgcagttcaaaacggtgtaaatgcggaaagcgagcgcaaaatttcagcaaaaaaccacgtccggtgccttcgtagccctgcaccgtagtggttaacaacgttcgaggaaaacgcgataccagttgatgcaacaatggcgcaggtatggctgcggcttcatcgaccaccagccagtcggcttgctcatcgctggctaacaaggcatccggcgcaataaagcgaaacttctcgcccgcaaattgtgccagtacatccgttgacgcttttgcgggcgcggtgacaatcgctctgcccgcaatacgagaaatgagttgccctgccaacgccgacttaccgcgcccacgcgcagccgttaccgctgccacgcccggcggcatggtcattagctgctttaagagttgctgttgttctggttgtggtgcgccagtcgcggggtaccagtcagtacggggagtaaaatgcgccaacgagaatggctggttttgccgccagaggatagcctcgttatccgccgtaagtacgcgtttgagatgctggacaaaatgcggcgtcgcaatagggtcagggcaatcactccagcgcagcgagtcggcatcaggttggttttcccactcttcccatacagggagtaacaaaaccagccagcttcccgctttcaacgttccgctaagtgcggcaaaggcagcggcatcaaagccgtggcgggcgtcgaataccgcatgccggaactcgcgcccaagtaaagtttgtagtgccgagggagaacagtggttttcagcatctggccgcggcgaaatccacagccagtcgccaggtaaggcatcacgcaacttaagagtatgctcaaaacaccaaccctcttccccgctcaacaccagcaagcggcggatcccttcacgtttcatttgcgctgttaatgtgtgaagcgcagtcagttcagccatccctgccccggaagttaaatgcttttaccaaaagtattgcattgtgccggatcgccgctgtcgaaaccacgtttaaaccagctgtagcgttgctgagaagtgccatgagtgaaactgtctggtactactcgcccctgactttgctgttgtaaacggtcatcgccgatggcctgcgccgcgttcagcgcctcttccagatcgccggtttccagaacgccttgctgctgcatactatgcccccagacaccggcaaaacagtcggcctggagttccatacgcacagataagcggtttacttccgcctgcgtcgcgttttgttgcagttgacgaactttcggctcgatgcctaacagtttctgcacatgatgaccgacttcatgggcgataacgtacccctgggcaaaatcgccatccgcgccaagtttgtctttcatgtcatcatagaaggagagatcgatataaaccgtgccatccgccgggcaatagaacggccccattatggactggcccgccccgcagccggtacgcgtcattccacggtacatgaccagcttcggttgctgataggtcttacccatcttctcgaactgttgtccccaggtgtcttccgtggttgccagaatcaccgaggtgaattttgcggcttcgtcttcatttgggctaattgaccgcgttgattgttgttgggaaaccggctgcccggtcatcaacccggttaaatcaacaccatagtagcctgcaaccagcacgactatcagtaaaatcagcccgcctttaccgcttggcaggcgaaaaccgggaccgcccatagatggaccaccagagctgttgcgcctgtcttcaacattgtcactttcacgtcgcccttgccaacgcatagatacctcaacaatatattcattatagaaatgatcgtaggtggttcagaggaagattaccacaggaaagcgggatgaaatggcggaggaatgagcgttcaatgcatatattccgagagcggttgtcttgccgtgccagctgcacggcaagatgatgaacagaaaaatcagtccagctgtacacccaggcggcgggcgacggcttcataggcttcgatcaggccaccgaggctctggcggaaacggtctttgtccattttctccagcgtttctttgtcccacaggcggctaccgtccggggagaactcatcacccagtaccacttcgcctttgtacagaccaaattccagcttgaagtcgaccagaatcagaccagcatcatcgaacagttttttcagcacgtcgttcgctttgtaggtcagctctttcatacgcgccaggttctctttgctcacccagccaaaggtttcgcagtaagattcgttgaccatcggatcgtgcatggcgtcgtttttcaggaacagatcgaacagcggcgggttcagctcaataccttcttcgattccaagacgtttcaccagagagccagcagcacggttacgcacgacacactcaaccggcaccatatccagctttttcaccagacattcggtatcggagagcagacgctccatttgagtcgggatacccgcttcagccagtttgctcataatgaagtagttgaacttgttgttcaccatacctttgcgatcaaactgctcaatgcgcgcgccatcccctgctgacgtatcattgcggaattcgagcaccaacaggtccgggttttccgtgctgtatacggttttcgctttaccacgatacaactcagcttgcttttgcatctttatcactcctgggtgtgaattaacgttttaaaatcttttgctgtctggtgtgccggatgttttgtcggatgcggcgtgaacgccttatccgaactacgtccgacaaacaaatttcgtgcgaattaccgctaaaatcgcgttttcctgcagacgcacacgtttgcgtatcatatcagaaaaaagggccggatgattccagccctgtatttttacttgctaaacgcagcctggaagacagctaccagcgcgtcgttctgactctgagtcagagtatgacctttcggatcgatgaactgtaggctgctgcggttatctaaatcgccaacctgcagtttatagtcaccggatgccaggcctggatcgctcgcgcccagttcctgccagtcgctgtcagacagcggcttataagttacggccatgttgccctgcgaacgggtgctgtcggtcactttcatgcccactttttccagcgccgctggcagacgttgccaaaccacattgaacggcccgcgtacgaccagcattggtaaaccggtgtcatcagctgcactttgtacgtccatagtggtggaggcacgattttgcgcagcgttcgcggcgtcagtggcagatttatccagaccggcggaaataacgttcatcatctccgtgctgtaacgctgcatggaagccgcgtctgcaaccggtttgcccgcctgttccaggttcagcagtttaaccgtaaccgcctgctgataaccctgcggcttaacagagatttgataacgaccacgatactgctcgtcttcgtccagacggttccattgtacccaatcggtggtcagtgtctgaccagcatcatcacgttgggtgatggtgtagtttttcgcctgcagcacgctaaccacctgcggccacagagtattgccacgaccattttccaccagcaatgaagcggtatcgcccgtgaactgggtacgcgcgccagaaaccagtgccagcggctgggctggtggacgaatgtccagcgccttaccgacagcaccactaccgttggtcaccgggattgcataatcaccggaggtcaccggcaaaatcattccagccggggcatgaagctccgcaagcggtgccgcttccaggtaggcttcatcaccactgacctgacgcttatagcgtgagtcagaactacaggcagcgagtaataaaacaagcgaaacacccgcaacctttgccaggcgcgacttttgaacagagtaagccatcaaatctccctaaactttacagcaaaccggcatgcttaagcgccgctctgaccgtctcacgaccactgtcggtgattggtgtcattggcaggcgcagcgtatcggtcgccacaagacccagttccttacatgcccatttcaccgggattggattgggttcgacaaatagtttgttgtgtaatggcatcagacgctgattaataacgcgtgcctcggcaaaatgcccttctgctgccagtttgcacatctgggccatatcacgcgctgcgacgttagccgtaacggaaataaccccatgaccgcccaattgcatgaagtccagcgcgctcgcatcatcgccgctcagcagaacaaaatcatctgaaaccagctctttgatctggtttacacgcgttaagttccctgttgcctctttgattccgataatattttttactttcgccagacggcccaccgtttccgggagcagatcgcagccagtacgggacggcacattatacagaatttgcggcaggtcagtatgctcagcgatggctttgaaatgctgatacaaaccttcttgcgacggacgattgtagtaaggggttaccgtcaggcagccgacgataccactgtcattgaagcgctgcgtcaggctaatggcttccgcagtagcgttagcgccggtcccggcaattaccggaatgcgcccatcagccagatccagcgtcatcatcaccacatcagcatgttcgtcatgatttaaggtagcggactcgccagtggtgccaacagaaacgatcgccgaagtaccgctggcgacatgataatcaatcagttttttcaagctagcccgacagacattacctttttcatccatcggagtaacaatcgcgacaatacttcccgtgaacatgggccatcctctgtgcaaacaagtgtctcaatggtacgtttggtatggcattaaaagcaagcagacagaaccgttctgattgttgtatgcatgttttttttatgctttccttaagaacaactcaccccttaaaggaataaccagtttgacactgtcatcgcaacattatctggtgatcactgcgttgggtgccgatcgccctggaattgtgaacaccatcacccgtcatgtcagtagttgcggctgtaatattgaagacagtcgcctggcgatgctgggagaagagttcacgtttattatgctgctttccggttcatggaatgccattactctgattgaatcaacgttaccgttgaaaggtgccgaactggatcttttaatcgtgatgaagcgcacgacggcgcgtccgcgtccgccaatgccagcatctgtctgggttcaggtcgatgtggcagactccccgcatttaattgaacgcttcacagcacttttcgacgcgcatcatatgaacattgcggagctggtgtcgcgcacgcaacctgctgaaaatgaacgggctgcgcagttgcatattcagataaccgcccacagccccgcatctgcggacgcagcaaatattgagcaagcgttcaaagccctatgtacagaactcaatgcacaaggcagtattaacgtcgtcaattattcccaacatgatgaacaggatggagttaagtaatgaatccactgaaagccggtgatatcgcaccgaaatttagcttgccggatcaagacggagaacaagttaatttgaccgacttccagggacagcgtgttctggtttatttctacccgaaagccatgacccccggctgtaccgtacaggcctgcggcttacgcgataacatggatgagttgaaaaaagcgggcgttgatgtgctgggtatcagcaccgataaacccgaaaaactctcccgttttgcggaaaaagagctgcttaactttacgctcctgtctgatgaggaccaccaggtgtgcgaacaattcggcgtctggggtgaaaagtccttcatgggcaaaacctacgatggcattcatcgcatcagcttcctgattgacgctgatggcaaaatcgaacatgtctttgacgatttcaaaaccagcaatcaccacgacgttgtgctgaactggctgaaagaacacgcctgattactttgctccattccgtgctggctgcgcttgcggccagcatacctcacttctcgtgatcaagatcacattctcgctttcccctgcgacacgggtgtcgaatccattttttgctgaacgttaatgaccatcatttttgtaccgttcagaatccagttaatacataacttattgaatatattgagttaatcagaatggcatcctttatgcaatatgaaatgcaatgtttcatatcattttcaaggagccgacatgaaccgctttgtggtggccgaaccactgtggtgtacaggatgtaatacctgtctcgctgcctgttcggacgtgcataaaacgcaaggtttacagcaacacccgcgcctggccctggcgaagacgtcaacaatcactgcccctgtcgtgtgtcatcactgtgaggaagccccttgcctgcaggtctgcccggtcaatgccatctctcagagggatgatgcgatccaactcaacgaaagcctctgtattggctgcaagctttgcgccgtggtctgcccatttggcgcaatcagcgcttcaggaagccgtccggtgaatgcccatgcgcaatatgtttttcaggctgaaggctcactcaaagacggcgaagaaaacgcgccaacacaacatgctttgctgcgctgggaacctggtgtccagaccgtcgcggtgaaatgcgacctgtgtgatttcttgccagaaggtccggcctgcgttcgcgcttgcccgaatcaggcgttacggctgatcaccggtgatagcctgcaacgtcagatgaaagaaaaacagcgccttgccgcaagctggtttgccaatggcggggaggatcccctttccctcactcaggagcaacgctaatggatgccctgcaattattaacctggtcgctgattctctatctgtttgctagtctggcttcgctgtttttactcggtctggacagactggctattaagctttccggcatcacatcgctggtgggcggcgtgattggcatcatcagcggaattacgcaattacatgctggtgtaactttagtcgcccgttttgcccccccttttgaatttgccgatttaaccctgcgaatggatagcctctcggcatttatggtgctggttatctccttgctggtggtggtttgttctctctattcattgacttatatgcgcgaatacgagggcaaaggcgcggcggcgatgggcttctttatgaatattttcatcgcatcgatggttgccctgctggtgatggacaacgctttttggttcatcgtgctgtttgaaatgatgtcgctgtcttcctggtttctggtcattgccaggcaggataaaacgtcgatcaacgctggcatgctctacttttttatcgcccacgccggatcggtgctgataatgatcgccttcttgctgatggggcgcgaaagcggcagcctcgattttgccagtttccgcacgctttcactttctccggggctggcgtcggcggtgttcctgctggcctttttcggttttggcgcgaaagccgggatgatgccgttgcacagctggttgccgcgcgctcaccctgccgcaccatcgcacgcttcggcgttgatgtctggcgtaatggtcaaaataggtattttcggcatcctgaaagtagcgatggatctgctggcgcaaacgggtttgcctctgtggtggggcattctggtgatggcgatcggcgcaatctccgcgctcctgggcgtgctatatgcgctggcggaacaggatatcaaacggctgctggcctggagtaccgtcgaaaacgtcggcattattttgctggcagtcggtgtggcgatggtcggtctgtcactgcacgacccgctgctcaccgtggttggactgctcggcgcactgtttcatctgctcaaccatgcgctgttcaaagggctgctatttctcggcgcgggagcgattatttcgcgtttgcatacccacgacatggaaaaaatgggggcactagcgaaacggatgccgtggacagccgcagcatgcctgattggttgcctcgcgatatcagccattcctccgctgaatggttttatcagcgaatggtacacctggcagtcgctgttctcactaagtcgtgtggaagccgtagcgctacaacttgcgggtcctattgctatggtaatgctggcagtcactggtgggctggcagtaatgtgcttcgtaaaaatgtacggtattactttctgtggtgcgccgcgcagtacacacgctgaagaggcacaggaagtgccaaatacgatgatcgtcgccatgctactgctcgcggcactctgcgtattaattgcgcttagtgccagttggctggcaccgaagataatgcatattgcccatgcgtttaccaatacccctcccgccactgtcgccagcggaatagcacttgtacccggcacgtttcatacacaggtcaccccctcattactgttgctgttactactggcgatgcctttgctgcctggcctttactggctgtggtgtcgttcgcgccgcgcagcgtttcgtcgcacaggagatgcctgggcatgcggctacggctgggaaaatgcgatggccccgtcaggcaatggcgtgatgcagccgctgcgtgtggtcttttctgcgctatttcgtctacgacaacagctcgaccctacgctgaggctaaataaaggtcttgcgcacgtcaccgccagggctcagagcacagaacccttctgggatgagcgggtgatccgccccatcgtgagcgccacccaacggctggccaaagaaatacagcatctgcaaagcggcgactttcgtctctattgcctgtatgtggtcgccgcactggttgtgctgctaatcgctattgccgtctaaggaaatcaccatgagacaaactctttgcgacggatatctggtcatttttgcgttagcacaggccgtgattctgctgatgctaaccccactttttacgggtatttcccggcagatacgcgcgcgtatgcactcccgccgcgggccggggatctggcaggattatcgcgatatccacaaactgtttaaacgccaggaagttgcgccgacatcttcaggtctgatgttccgcctgatgccgtgggtattaatcagcagcatgctggtgctggcgatggccttaccactgtttattaccgtttccccttttgcgggcggcggcgatctgatcacccttatctatcttcttgccctgtttcgttttttctttgctctttccgggctggataccggaagtccgtttgcgggagtcggtgccagtcgcgagttgacgctcggcattctggtcgaaccaatgcttattctctcactgctggtattggcgctgatagcaggttccacgcatatcgagatgatcagcaatacgctggcgatgggctggaactcgccgctaaccaccgtactggcgttactggcctgtggttttgcctgcttcattgagatgggaaaaattccctttgatgttgctgaagcagaacaggaattacaggaaggcccgctgaccgaatattccggtgccgggctggcgctagcgaaatgggggctggggctgaaacaggtcgtgatggcatcactgtttgtggccctgtttctgccctttgggcgcgcgcaagaactttctctcgcctgcctgctgacttcacttgtcgttacgctgctcaaggttttgctgatttttgtactggcctcaatcgcagaaaacacgctggcacgcgggcgttttttactcattcaccatgtgacctggcttggcttcagccttgctgcgcttgcatgggtcttctggttaaccggtctgtaaggagcactgacggaatatggaaaatcttgctctgacgacgttattgctgccttttatcggcgcactggtcgtttcgttttcgccacaacgtcgggccgccgaatggggggttttgttcgccgcgctgaccacgctgtgcatgttgtcactgatctccgcgttttatcaggccgataaagttgccgtcacgttgacgttggtcaacgtgggggatgtggcgttgtttggcctggtcattgatcgcgtgagtacgctgattctgtttgtggtggtgtttctcggtttgctggtcacgatctactccacgggttatctgacggataaaaatcgcgaacacccgcataacggcacgaatcgttattacgcatttttactggtgtttatcggcgcgatggcgggactggtactctcctcgacgctgctcggtcagttgttgttttttgaaattacaggcggctgctcctgggcgttgatcagttattaccagagcgataaagcgcagcgttcagcactaaaagcgttacttatcactcatatcggctcgttggggttgtatcttgccgccgccacgctgtttttgcagaccggaacgtttgcgcttagcgcgatgagcgagttacacggcgacgcacgttatctggtttatggcggcatcctgtttgccgcgtgggggaaatcggcccagctaccgatgcaagcgtggctaccggacgcaatggaagcgccaacaccgatcagcgcctatctccacgccgcatcgatggtgaaagtgggcgtttacatttttgcccgcgctattatcgacggcggcaatatcccgcatgtgattggcggcgttggcatggtcatggcactggtcaccattctttatggctttctgatgtatttgccacagcaggatatgaagcggttgctagcctggtcgaccatcactcaacttggctggatgttcttcggcttgtcgctctccatcttcggctcgcggctggcgctggagggcagcatcgcctacatcgtcaaccacgcgttcgctaaaagcctgtttttccttgtagcaggtgcgctgagttacagctgcggcacgcgcttgttgccgcgtctgcgtggcgtattgcacaccctgccgttgccaggcgtgggtttctgcgtggcagcgctggcgattaccggcgtgccgccgttcaacggcttcttcagtaaattcccgctgtttgctgccggttttgcgttgtcagtggagtactggatcctgctgcccgccatgattcttctgatgattgaatcggtcgccagtttcgcctggtttattcgctggtttggtcgcgttgtgcctggcaaaccgagcgaggccgtcgccgatgccgcaccgctgccaggatcaatgcgcctggtgttgattgtactgattgtgatgtcgctgatttccagcgtaatcgccgcgacctggttgcagtaaggagatgatgaatgaccggttctatgatcgtaaataatctggcgggactgatgatgctgacatcgctgtttgtgattagcgtcaaaagctatcgcctgtcatgcggattttacgcctgccagtcactggtgctggtgtctattttcgccactctctcgtgcctgttcgccgcagagcaactgctgatctggtccgccagcgcctttatcaccaaagtgctgctggtaccgttaatcatgacttacgctgcacgaaatattccccagaacatcccggaaaaagcgttattcggtccggcaatgatggcactgctcgcggcgttaattgtcctgctttgcgcatttgtcgttcagcccgtgaagctaccgatggctaccgggctgaaaccggcgctggcggtagcgttaggtcattttctgcttggcctgctgtgcattgtcagccagcgcaatatcctgcggcaaatttttggttactgcctgatggaaaacggctcccatctggtgctggcgcttcttgcctggcgagcaccggaactggtggaaataggtatcgctaccgacgccatcttcgccgtcattgtgatggtgttactggcaagaaaaatatggcgtacccacggcacgctggacgtgaacaacttgaccgcgctgaagggataatgagatgagttattctgtgatgttcgctttactcctgctcacgccgctgcttttttcgctgctctgttttgcctgccggaaacggagactttctgcgactcgcacggtgaccgtattacatagcttagggatcacactgctgctgattctggcactctgggtggtccaaactgccgctgatgcaggagaaatattcgctgcgggactgtggcttcatattgatggtctgggcggtttgttcctcgccattcttggtgtgattggctttctcaccggtatttactcgattggctacatgcgtcatgaagtggcacacggcgagctttcacccgttacgctgtgcgattactacggtttcttccatctgtttttgttcaccatgctgctggttgttaccagcaataacctgattgtgatgtgggcggcgatcgaagccaccaccttaagctcggcgtttctggtaggcatttacggtcagcgttcatcgctggaagctgcatggaagtacatcattatttgtactgttggtgtcgcttttggtctgttcggtaccgtgctggtatacgccaacgccgccagcgttatgccgcaggcagaaatggcgatattctggagcgaggttcttaagcaatcgtccttgcttgacccaacattaatgctgttggcctttgtgtttttgctaattggctttggtaccaaaaccgggctatttcccatgcacgcctggctgccggatgctcacagtgaagcgccgagtccggtcagcgccctgctctccgccgtattgctgaactgcgcgctgttggtgctgattcgctattacatcattatttgccaagccatcggcagcgatttccccaaccggttgttgctcatcttcggcatgttgtcggttgccgtggcggcatttttcattctggtacagcgggacattaagcgtctgctggcgtactccagcgtggagaacatggggctggtcgcggtggagctaggcattggcgggccgctgggaatttttgccgcgctgctgcacatcttaaaccacagtctggcaaaaacgctgctgttctgcggttccggcaatgtactgctcaagtacggcacgcgcgatctcaacgtcgtctgtgggatgctcaaaatcatgccatttaccgccgtgctgtttggcggcggtgcgctggcgctggcagggatgccgcccttcaacatttttcttagcgaatttatgaccattaccgccggactggcacgtaatcacctgctgattatcgtcctgctgttattgctgttaacgctggtgctggcgggcctggtacggatggctgcgcgggtgttaatggcgaaaccgccgcaggccgttaaccggggtgatctcggctggttgaccacctcgccaatggtgattctgctggtcatgatgctggcgatgggaacgcatattccacaacctgtcatcaggatcctggcgggcgcttccactatagtcctctcagggacgcacgatctgcctgcacaacgtagcacctggcatgattttttgccttcaggcaccgcatctgtttcggagaaacacagtgaacgttaattcatcgtcaaatcgtggcgaagcgattctcgccgccctgaaaacgcagttccccggcgcggtgctggatgaagagcgacaaacgcctgaacaggtcaccattacggtgaaaatcaatctgctgcctgacgttgtacagtatctttattatcaacatgatggctggcttccggtcctgtttggcaacgacgagcggacacttaacggtcattacgcggtttattatgccctttcaatggaaggggccgaaaaatgctggattgtggtgaaggcgctggtcgatgccgacagtcgggagtttccgtcagtcacaccgcgcgtccctgccgcggtctggggcgagcgagaaattcgcgatatgtacgggctgattccggttggcctgccggatcagcgtcgcctggtgttgcccgatgactggccggaagatatgcatccgctgcgcaaagatgcgatggattatcgactgcgccctgaaccgacgactgattccgaaacgtatccgtttatcaatgagggcaacagcgatgcgcgggtgatccctgtcggcccgctgcatatcacctccgatgaaccgggtcacttccgcttgtttgtggatggcgagcaaattgtcgatgctgattaccgcctgttttatgtccatcgcggcatggagaaactggcagaaacgcggatgggctacaacgaagtgaccttcttatcggaccgcgtgtgtgggatttgcggttttgcccacagtgtggcctataccaattcggttgaaaatgcactggggattgaggtgccgcaacgagcacatactattcgctcgattctgctggaagtcgaacggctacacagtcatttgcttaaccttggcctctcctgccatttcgttggttttgataccggctttatgcaatttttccgcgtgcgggaaaagtcgatgacgatggcggaattgctgatcgggtcgcgtaaaacctacggtctgaatctgattggtggtgttcgccgcgatattctcaaagagcaacgtctgcaaacgctgaaactggtgcgcgagatgcgcgccgacgtgtcggagctggtagagatgctgcttgctacgccgaatatggaacaacgcactcagggcattggcattctcgaccgacaaatcgcccgtgatttgcgctttgatcacccctacgccgactacggcaatattccaaaaacactgtttacctttaccggcggcgatgttttctcccgcgtgatggtccgtgtcaaagagacgtttgattcgctggcaatgctggaatttgccctcgacaacatgccggataccccactgctgaccgaaggctttagctataaacctcacgcattcgcgctgggctttgttgaagcgccacgcggtgaagacgtgcactggagcatgctcggtgataaccaaaaattgttccgctggcgctgccgtgccgccacctacgccaactggccggtgttgcgttacatgctgcgcggcaataccgtttctgacgcaccgctgattatcggtagccttgatccctgctactcctgtaccgaccgtgtgacgctggtagatgtgcgcaagcgccagtcaaaaaccgtgccgtataaagagatcgaacgctacggcattgatcgtaaccgttcgccgctgaagtaaggacagaagatgctgaagttactgaaaactattatgcgcgccggaaccgcgacggtgaaatatcccttcgcgccactggaggtcagccctggctttcgcggaaaaccggacctgatgcccagccaatgtattgcctgcggtgcctgcgcctgtgcttgtccggcaaatgcgctgactatccagaccgacgaccagcaaaattcgcgcacctggcagctctatctggggcgttgtatttactgcggacgttgtgaagaagtgtgcccgaccagagccatccagcttaccaataactttgaactgaccgtcaccaataaagccgatctctatacccgcgcgacgttccatctacaacgttgcagccgttgcgaacgcccgtttgccccgcaaaaaaccatcgcactggctgctgaattgttagcacagcaacaaaatgcgccacaaaaccgcgaaatgttgtgggcgcaagcgagcgtctgcccggaatgcaaacaacgcgcgacgctgatcaacgacgatacagatgtactgctggtggctaaggagcagctatgagtccagtgcttacacaacatgtcagccagcccatcacgctggacgagcaaacgcaaaagatgaagcggcatttgctacaggatatccgtcgctcggcttacgtttatcgcgtcgattgcggcggctgcaacgcctgtgaaatcgaaatttttgctgccattacaccagtattcgacgcagaacgttttggcattaaggttgtttcatcaccgcgtcacgccgatattttgttatttactggcgcagtcacccgggcgatgcgtatgcctgcacttcgggcgtatgagtctgcccccgatcataaaatttgtgtttcctacggcgcgtgcggtgtcggcggcggtattttccacgatctctacagcgtctggggcggtagcgacaccattgtccccattgatgtttggatccccggctgcccgccaacaccggccgccaccattcacggtttcgccgtggcgctcggtttgctgcaacagaagattcacgctgtggattatcgcgatcccaccggggtgactatgcaaccgttgtggccgcagatcccgccatcacagcgtatcgccattgagcgagaagcgcggcggctggcgggctatcgtcaggggcgagaaatttgcgatcggctcctgcgccatttaagcgacgatcctacaggaaatcgggttaacacctggttgcgcgatgccgacgatccacgtctcaatagtatcgttcagcaactctttcgcgtactccgggggttacatgactgaagagtgcggggaaattgttttctggacgctgcgaaaaaagtttgtcgccagtagcgacgagatgccggaacacagctctcaggtaatgtattactcgctagctatcggccatcacgttggcgtgattgattgtctgaatgtcgccttccgctgcccactgacggaatacgaagattggcttgcactggtcgaagaggagcaagcccgacgtaagatgctgggggtgatgacttttggtgagattgttattgacgccagccacaccgccctgttgacccgggcattcgcgccactggcggatgacgcgacgtctgtgtggcaggcgcgtagcattcaattcattcatctgttggatgaaattgtgcaggaaccggccatctatctgatggccagaaaaattgcgtgagaaggatttctcattaataaggactgttgatggctatgtcagacgaggcgatgtttgccccgccacaaggaataacaattgaagcggtaaacggaatgctcgcggagcggttagcacagaaacacggcaaggcgtctttattacgcgccttcatcccgctgccgccgccgttcagcccggtacaacttattgaactgcatgttctcaaaagcaacttctattaccgctaccatgatgatggcagcgatgtgacggcaacaacagagtatcagggcgagatggtcgattattcgcgtcacgccgtccttctcggcagtagtggaatggcggagctacgctttattcgcacccacggcagtcgttttacttcccaggattgcacactgtttaactggctggcgcggataatcaccccggttctgcaatcatggctcaatgatgaagaacagcaggtggcgctgcgtttgctggagaaagatcgcgatcatcatcgggtactggttgatattactaatgcagtgctgtcacatcttgatctcgacgatctgatcgctgacgtcgctcgtgagatccatcattttttcggtctggcttcagtcagtatggtactgggcgatcatcgaaagaacgagaagttcagcctgtggtgcagcgatctttctgcctcacattgtgcgtgtctgccacgctgtatgcctggcgaaagtgtattgctgacacaaacgctacaaacccgacaaccgaccttgacgcaccgtgcagatgatctgtttctctggcaacgcgacccgttattactcttacttgcatctaacggctgcgaatctgcgctccttataccgcttacctttggcaaccatacaccgggtgcattgttgctggcgcatacctcttccactctctttagtgaggaaaactgccagctactacaacacatagccgatcgcatcgctattgccgttggcaatgccgatgcctggcgtagcatgaccgatttgcaggaaagtttgcagcaagaaaaccaccagcttagcgagcagctcctttcgaatctgggcatcggtgacattatctatcaaagccaggcaatggaagacctgctccagcaggtagatattgtggcgaagagcgacagtacggtgttgatttgtggtgaaaccggaactggcaaagaggtgatcgccagagcgatccatcaacttagcccgcgacgcgacaagccgctggtcaaaatcaactgcgctgccatccccgccagtcttctggaaagtgagttattcggtcatgacaaaggggcgtttactggtgcgattaatacccatcgtggtcgttttgaaattgccgatggcggcacgttgtttctcgatgaaattggcgatctgccgttagaacttcagcctaaactgctgcgcgtattgcaggagcgggagattgagcgtctcggcgggagtagaacgatcccggtgaatgtcagagtcattgccgccaccaaccgtgatttgtggcaaatggttgaagatcgccagtttcgcagcgatctcttttatcgcctgaatgtcttcccactggaattgccgccgctacgcgaccgtccggaagatatccctcttttagcaaaacatttcacgcaaaaaatggcgcgccatatgaatcgcgcaattgacgccatcccgaccgaggcactacgccagttgatgtcgtgggattggccgggcaacgtgcgcgagctggaaaacgtgattgagcgggcggtactgttgactcgtggtaacagtctgaatttacatctaaatgtccgacaaagccgtttactgccgacgctaaatgaagattcagcgcttcgcagttcaatggcgcagttactgcacccgacgacgccagagaatgacgaagaagaacgtcagcgcattgttcaggtattgcgagaaaccaatggcattgttgccgggccccgtggcgcagcgacgcgattagggatgaagcgcaccacgctgctgtcacgaatgcagcggctggggatctcggttcgcgaggtgttgtaatctgcttttgcaggagtatgcatgagaaacaaactctctttcgacttgcagttgagcgccagaaaagcggcaatcgctgaacggattgccgcccataaaattgcccgcagtaaagtgtcggtctttttaatggcgatgtccgctggcgtgtttatggcgatcggatttactttttacctttccgttatcgccgatgccccgtcttcacaggcattaacccatctggtgggcggcctttgctttacactcggctttattttgctggcggtttgcggcaccagcctgttcacctcgtcggtaatgacggtgatggcaaaaagtcggggcgttattagttggcgaacttggctgattaacgcacttctggtggcctgcggtaatctggcaggtattgcctgtttcagtttgttaatctggttttccgggctggtgatgagtgaaaacgcgatgtggggagtcgcggttttacactgcgccgagggcaaaatgcatcatacatttactgaatctgtcagcctcggcattatgtgcaatctgatggtttgcctggcgctgtggatgagttattgcgggcgttcgttatgcgacaaaatcgtcgccatgattttgcccatcaccctgtttgtcgccagtggctttgagcactgtatcgccaatttgtttgtgattccgttcgccattgccattcgccatttcgcccctccccccttctggcagctggcgcacagtagcgcagacaattttccggcactgacggtcagccattttattaccgccaatctgctcccggtgatgctgggtaatattatcggcggtgcggtgctggtgagtatgtgttatcgggctatttatttacgtcaggaaccctgaaaaatcagcccggcgaaacagttcgtcgggctgaagattattcttgcgcgatttgcccatcgggccaggcatgaatcacggctttgatcagcgtcgccaacggaatggcgaagaatacgccccagaatccccacaaaccaccgaagatcaccaccgataaaataatcaccagcggatgcaggttaaccgcttcggagaacaacaccggcactaacaggttgccgtccagcgcctgaataatcagatacaccgcgaagcagctccagaattcagtacctgcgccaaactggaatagcgccacgccaaccaccggaatggtcaccacaaatgcgccaatgtacggaataagaaccgagaagccgaccagcactgccagcagcagcgaatagttcagcccgaagagcaagaaccccagccaggtggcgatccccaccacgatcatctccagcactttgccgcggatatagttggtgatttgttgattcatctccttccacacctgtcctgccagcccacggttacgcggcagcacccggcgaacggcgttcagcatctgctctttgtctttcagcaggaagaagaccatcaatggcaccagcaccagatagacggctatggtcagcaaaccgaccagcgaggcgagggaaattttcaccaccgaatcgcccatggtcagcatccgactgcgcatattttcggccattgcatcaataatgcccgcgtccattaacgccggatagcggcgcggcaacgtggcggcaaagtcagaaagcttattgagcatccccggcatatcgcggattaagtagatgccctgttgccaggcgataggcagtaccacgaacgccatcagtagcaatataccgacgaaaaccaccaatacaatcgacgtcgcccagcggcgggagcagccaatagattgcagacgcacggttggccattccagcaaataggccagcacaatagccaccagcaacggagcaagcaggccactaaagaaaaagataatgccaaatccggcaactaaaataaccagcaaggcaatcgcttccgggtcgctaaaacggcggcgataccattgcatcaacatttcgagcataaagaccttccctgaacctcaagagcgggattgcgatccgcaattgtatcgaaatgtcacaaaaaagacttcgctttttatgacggattcaggaaactgaaaagtcatttgagtgggctaatcttcgccgttacactcaaaggcggcgcggtgggaacgatatttcacagtatcggtcaaatgactatctccagaaatacaggatagaggttatgttcaggcagttgaaaaaaaacctggttgcaaccctcattgctgctatgaccattggtcaggtagccccggcgtttgccgacagcgcagacaccttgccggatatgggaacctccgcaggaagcacgctttccattggtcaggaaatgcagatgggcgactattatgtccgccagctacgcggcagcgcgccgttaattaatgacccgctgttaacgcaatatattaattcgctggggatgcgtctggtttcgcatgccaattcggttaagacaccgtttcatttttttctgatcaacaacgacgaaattaacgcctttgctttctttggcggcaacgtggtgctgcactctgccctgttccgttattccgataacgaaagtcaactggcttcagttatggcgcacgaaatctcccacgtcacccaacgtcacctggcgcgagcgatggaagatcagcagcgcagcgcgccgctgacctgggtcggcgcgttaggttctattttactggcgatggccagtccgcaggcggggatggcggcgctgaccggtacactggcgggaacgcgtcaggggatgatcagtttcacccagcaaaatgaacaggaagcggaccgcattggtattcaggtgctgcaacgctcgggattcgatccgcaggcgatgccaaccttcctcgaaaaattactcgatcaggcgcgttactcctcgcgcccgccggaaattttattgactcacccgttgccggaaagtcgtctggcagatgcccgcaaccgtgctaatcagatgcgcccgatggtggtgcagtcgtcggaagatttctatctggcgaaagcgcgcacactggggatgtataattccggacgtaaccagctcaccagtgatttgctggatgaatgggcgaaaggaaacgttcgtcagcaacgagcagcacaatatggtcgtgctttacaggcgatggaagccaataaatacgacgaggcgcgtaaaacgctgcaaccgttactggcggcagaacctggcaacgcatggtatctcgatctggctactgatatcgatcttgggcaaaacaaagccaatgaggcgatcaatcgtctgaaaaatgcccgcgatttacgcaccaatccggtgttgcagctcaacctggcgaacgcttatttgcaaggcggtcaaccacaagaagcggccaatattctgaatcgctacacctttaataataaagatgacagcaacggctgggatttgctggcacaggcggaagccgcgctaaataaccgcgatcaggagctggctgcgcgagcagaaggttatgcgctcgccggacgactcgatcaggccatttcgctgttgagtagcgccagttcgcaggtgaaattaggcagcctgcaacaagcgcgttacgatgcgcgcatcgaccagttgcgccagctgcaggaacgctttaagccttataccaagatgtaattcgcattaaaggaagaacaatgaccaaacaggtaaaaatctaccataacccacgctgttcaaagagccgggaaacgctgaacctgctgaaagaaaacggcgtggagccagaagtggtgctctaccttgagacacccgccgatgcggcaacgctgcgcgatttgctgaaaatactggggatgaatagcgcccgtgaattgatgcgccagaaagaggatctttataaagaactgaacctggctgacagttcgcttagcgaagaggcgctgattcaggcaatggtggataatccgaagctgatggagcgcccgattgtggtcgcgaatggcaaagcgcggattggtcgtccaccggagcaggtactggaaatcgtgggttaagatgtgctccatcgctagttgaagcacattgccggatgcgacgcttgccacgtcttatccggcctacgaatactatggattaacttcgcgtagttcggataaggcgttcgcgccgcatccgacaataaacaccttatctacaacttcagaatttctttcacaaacggaatggtcagcttacgttgcgcggtaatcgacgcacgatccaactgatccaacgtcataaatagcgtgcgcatttctctgtcgagccgcttcagcaagaaacgccccacatcttccggcagttcaaaaccacgcaaacgcgcgcgtaactgtagcgcctgcaacttatcttcatcagaaagtggctgcaatttgtagatctgcccccagtcgagtcgcgacgcgagatccggtaatcccagattcaactgccgcggtggacgatcgccggtgatcaacaaccgtgttttgcccgattccagaattcgattgtagagatcgaaaatcgccatctcccacaactcatcgcctgcaatacactcaatgttgtcgatacagaccagcgacaaatgctccataccgtcgagcacttccggaacaaaccaggtgcgtttatccagcgggacatagcccaccgcatcgccacgctgcgacaattccgcgcaagccgcgtgcagcagatggctgcgccccgcgccttcgcgtgcccagagatagatgtaaccgctatgttcctgacgcagcacgttttgcagcgcggccagtaaagaggagttatcccccggccagaaacttgcaaaggtttcgtcgtcaggaagataaagtggcaaagagagctgtgccggtgtgttcagagatacctcaaccaggatttcacaaaatcgcgagaagtttaccacagaatcccatgatgtttgaaccgggcagcaacactgcccggtcggtacattatttgtctgttatatccgcgtcttctgcgtccagcaccacttcttcagggcgcagcacactgatcagtttgaagatcaaacttaagccgataccgacgatggtcgccagcgccataccttttaactccgccgcgccgatgtttaccttcgcgccactgacgccgatgatcaaaatcacggaagtcaggatcaggttctgtgctttgttgtaatccactttcgattcgatcaaaacacgaataccggaagcaccgatgacaccataaagcagcagcgaaacgccgcccatcaccggcaatgggatcatctggatagcggcagccagtttaccgacgcaggaaagcaggatagcgaaaatcgccgccccgccgataacccaggtactgtaaacacgggtgatcgccatcacgccaatgttttctccgtaagtagtatttggcgtagagccaaagaagccggaaatcacggtcgacaagccattagcaaacatcgaacggtgcagacctggatcgcgcagcagatcttttttgacgatattagccgttactaccaggtgccctacgtgttcggcaataaccactaacgccgctggcagaatagtcagaatggcaaaccactcgaagcgcggcgtatagagggttggcagcgcaaaccagtgagcattaataatcggcgtggtatcgacaattcccattgcgaaagagagcgcgtaccccaccagcacgccaattaaaatcgggataattgccaggaaaccacgaaacagcacggaacctaaaaccgtgaccgccagggtggtaatagagatgatgatggttttggagtctggcgtttgcccttcagccgggagtaaacccgccataccggcagctacgcccgccagctccagaccgatgacggcaacgattgcgcccattgccgcaggtggaaacagcacgtccagccagccggtccccgctttcttcacgataaaagaaaccaggcagaacagcacgccgcacataataaagccgcccagcgcgacttcataccctaacggcaacagtaacaataccggtgaaataaaggcaaagctggaaccaagataagccggaattttccctttacagatgaagagatacagcagcgttccaataccgttaaataacagtacagtcgccgggttaatatgaaataagacgggcaccaggacggttgcaccaaacatggcgaacaaatgttgcaaactaagcgggattgtctgtaaaagtggcggtctttcactcaccccgatagcacggcgcgtcatagtattatcctctgtattatgtgttataggcgctttactcaaaaaaaagccgactcttaaagtcggctttaattatttttattctttatttcgtaccaaagattttgtcaccggcatcgccgaggcccggaataatgtatccgtgctcgttcagtccctgatcaatcgatgcggtatacagttcgacgtccgggtgcgctttttccagcgcagcgataccttctggcgcagctaccagcaccagaactttgatgctgctgcagcccgcttttttcagcaggtcgatggtcgcgataacggaaccaccggttgccagcattgggtcaacgatcagcgccatacgctcatcgatgttagaaaccagtttctggaagtacggtaccggctccagcgtttcttcattacggtacataccgacaacgctgatgcgcgcgctcggaacgttttccagcacaccgtccatcataccaagacccgcacgcagaattggcacaacggtaattttcttacctttgatctggtcgatttctaccgggccgttccagccttcgatagttactttttccgtttcgaggtcggcggtcgcttcgtaagtcagcaggctacccacttcggaagcgagttcgcgaaagcgcttggtgctgatatcttgctcacgcatcagtcccagcttgtgtttgacgagtgggtgtttgacttccacgatcttcatactctttctcctttgaggggcagccacaaaaaaaatcgacggattatacctcctttcttcaaggcggcaatattcttttcgttgactttagtcaaaatgataacggtttgagataaagttattttatattcagatggttatgaaagaagattattccatccgaaaactaacctttaccctggcacaagtcttctttcgccgcgcgcctggggaaaagacgtgcaaaaaggttgtgtaaagcagtctcgcaaacgtttgctttccctgttagaattgcgccgaattttatttttctaccgcaagtaacgcgtggggacccaagcagtgaccgataaaacctctcttagctacaaagatgccggtgttgatattgacgcgggtaatgctctggttggaagaatcaaaggcgtagtgaagaaaacgcgtcgtccggaagtgatgggcggtctgggcggcttcggtgcgctgtgtgcattgccgcaaaaatatcgtgaacccgtgctggtttctggcactgacggcgtaggtaccaagctgcgtctggcaatggacttaaaacgtcacgacaccattggtattgatctggtcgccatgtgcgttaatgacctggtggtgcaaggtgcagagccgctgtttttcctcgactattacgcaaccggaaaactggatgttgataccgcttcagcggtgatcagcggcattgcggaaggttgtctgcaatcaggctgttcactggtgggtggcgaaacggcagaaatgccggggatgtatcacggtgaggattacgatgtcgcgggtttctgcgttggcgtggtagaaaaatcagaaatcatcgacggctctaaagtcagcgacggcgatgtgctgattgcactcggttccagcggtccacactcgaacggctattcgctggtgcgcaaaattcttgaagtcagcggttgtgatccgcaaaccaccgaacttgatggtaagccattagccgatcatctgctggcaccgacccgcatttacgtgaagtcagtgctggagttgattgaaaaggtcgatgtgcatgccattgcgcacctgaccggcggcggcttctgggaaaacattccgcgcgtattgccagataatactcaggcagtgattgatgaatcttcctggcagtggccggaagtgttcaactggctgcaaacggcaggtaacgttgagcaccatgaaatgtatcgcaccttcaactgcggcgtcgggatgattattgccctgcctgctccggaagtggacaaagccctcgccctgctcaatgccaacggtgaaaacgcgtggaaaatcggtatcatcaaagcctctgattccgaacaacgcgtggttatcgaataatgaatattgtggtgcttatttccggcaacggaagtaatttacaggcaattattgacgcctgtaaaaccaacaaaattaaaggcaccgtacgggcagttttcagcaataaggccgacgcgttcggccttgaacgcgcccgccaggcgggtattgcaacgcatacgctcatcgccagcgcgtttgacagtcgtgaagcctatgaccgggagttgattcatgaaatcgacatgtacgcacccgatgtggtcgtgctggctggttttatgcgcattctcagcccggcgtttgtctcccactatgccgggcgtttgctgaacattcacccttctctgctgccgaaatatcccggattacacacccatcgtcaggcgctggaaaatggcgatgaagagcacggtacatcggtgcatttcgtcaccgatgaactggacggtggcccggttattttacaggcgaaagtcccggtatttgctggtgattcggaagatgacatcaccgcccgcgtgcaaacccaggaacacgccatttatccactggtgattagctggtttgccgatggtcgtctgaaaatgcacgaaaacgccgcgtggctggatggtcaacgtctgccgccgcagggctacgctgccgacgagtaatacccccgtaattaaagcgccagctctgccgctggcgtttttcaattcacctgtaaatcgcaagctccagcagtttttttcccccttttctggcatagttggacatctgccaatattgctcgccataatatccaggcagtgtcccgtgaataaaacggagtaaaagtggtaatgggtcaggaaaagctatacatcgaaaaagagctcagttggttatcgttcaatgaacgcgtgcttcaggaagcggcggacaaatctaacccgctgattgaaaggatgcgtttcctggggatctattccaataaccttgatgagttctataaagtccgcttcgctgaactgaagcgacgcatcattattagcgaagaacaaggctccaactctcattcccgccatttactgggcaaaattcagtcccgggtgctgaaagccgatcaggaattcgacggcctctacaacgagctattgctggagatggcgcgcaaccagatcttcctgattaatgaacgccagctctccgtcaatcaacaaaactggctgcgtcattattttaagcagtatctgcgtcagcacattacgccgattttaatcaatcctgacactgacttagtgcagttcctgaaagatgattacacctatctggcggtggaaattatccgtggcgataccatccgttacgcgctgctggagatcccatcagataaagtgccgcgctttgtgaatttaccgccagaagcgccgcgtcgacgcaagccgatgattcttctggataacattctgcgttactgccttgatgatattttcaaaggcttctttgattatgacgcgctgaatgcctattcaatgaagatgacccgcgatgccgaatacgatttagtgcatgagatggaagccagcctgatggagttgatgtcttccagtctcaagcagcgtttaactgctgagccggtgcgttttgtttatcagcgcgatatgcccaatgcgctggttgaagtgttacgcgaaaaactgactatttcccgctacgactccatcgtccccggcggtcgttatcataattttaaagactttattaatttccccaatgtcggcaaagccaatctggtgaacaaaccactgccgcgtttacgccatatttggtttgataaagcccagttccgcaatggttttgatgccattcgcgaacgcgatgtgttgctctattatccttatcacacctttgagcatgtgctggaactgctgcgtcaggcttcgttcgacccgagcgtactggcgattaaaattaacatttaccgcgtggcgaaagattcacgcatcatcgactcgatgatccacgccgcacataacggtaagaaagtcaccgtggtggttgagttacaggcgcgtttcgacgaagaagccaacattcactgggcgaagcgcctgaccgaagcaggcgtgcacgttatcttctctgcgccggggctgaaaattcacgccaaactgttcctgatttcacgtaaagaaaacggtgaagtggtgcgttatgcacacatcgggaccgggaactttaacgaaaaaaccgcgcgtctttatactgactattcgttgctgaccgccgatgcgcgcatcaccaacgaagtacggcgggtatttaactttattgaaaacccataccgtccggtgacatttgattatttaatggtatcgccgcaaaactcccgccgcctattgtatgaaatggtggaccgcgagatcgccaacgcgcagcaagggctgcccagtggtatcaccctgaagctaaataaccttgtcgataaaggcctggttgatcgtctgtatgcggcctccagctccggcgtaccggttaatctgctggttcgcggaatgtgttcgctgatccccaatctggaaggcattagcgacaacattcgtgccatcagtattgttgaccgttaccttgaacatgaccgggtttatatttttgaaaatggcggcgataaaaaggtctacctttcttccgccgactggatgacgcgcaatattgattatcgtattgaagtggcgacgccgctgctcgatccgcgcctgaagcagcgggtactggacatcatcgacatattgttcagcgatacggtcaaagcacgttatatcgataaagaactcagtaatcgctacgttccccgcggcaatcgccgcaaagtacgggcgcagttggcgatttatgactacatcaaatcactcgaacaacctgaataaccctatgccaatacacgataaatcccctcgtccgcaggagtttgctgcggtcgatcttggttcaaacagttttcacatggtcatagcccgtgtggtagatggtgccatgcagattattggccgcctgaaacagcgggtgcatctggcggacggcctggggccagataatatgttgagtgaagaggcaatgacgcgcggtttaaactgtctgtcgctgtttgccgaacggctacaagggttttctcctgccagcgtctgtatagttggtacccatacgctgcgtcaggcgctgaacgccactgactttctgaaacgcgcggaaaaggtcattccctacccgattgaaattatttccggtaatgaagaagcccgtctgatttttatgggcgtggaacatacccaaccggaaaaaggtcgcaaactggttattgatattggcggcggatctacggaactggtgattggtgaaaatttcgaacctattctcgttgaaagccgccggatgggttgtgtcagctttgcccagctttattttcctggcggggtcatcaataaagagaattttcagcgcgctcgcatggcggcagcacaaaaactggaaactttaacctggcaattccgtattcagggctggaacgttgcaatgggcgcttccggtaccataaaagccgcccatgaagtgttaatggaaatgggcgagaaagacgggataattaccccggaacgtctggaaaaactggtaaaagaagttttacgtcaccgtaatttcgcatcgctgagtttaccgggtctttccgaagagcggaaaacagtcttcgttccgggactggcgattttatgcggtgtgtttgatgctttagccatccgtgaactgcgcctttctgacggggcgttacgcgaaggcgtactgtatgaaatggaaggacgtttccgtcatcaggatgtgcgtagtcgcaccgccagcagcctcgccaaccagtatcacatcgacagcgaacaggcccgacgggtgctggataccactatgcaaatgtacgaacagtggcgggaacagcaaccgaagctggcgcatccgcaactggaggcgctactgcgatgggccgccatgctgcatgaggtcgggttgaatatcaaccacagcggtttgcatcgccactccgcttatattctgcaaaacagtgacttgccgggttttaatcaggaacagcagctgatgatggcgacactggtgcgctatcaccgtaaagcgattaagctcgacgatctaccgcgctttaccttgtttaagaagaaacagttcctgccactgatacagctattgcgccttggcgtattactcaacaatcaacgtcaggcaaccaccacaccgccaacattgacgctgattactgatgacagtcactggacactgcgtttcccgcatgactggtttagtcagaatgcgctggtactgcttgatctggaaaaggagcaagaatactgggaaggcgtggctggctggcggttgaaaattgaagaagaaagtacaccagaaatcgccgcttaatactttgcgggccgacgagaaatgtcggcccgcattattcaggcactttcgcgaatgggttcgatttcattcagcgtatcaattaacggctgcggcttaccaataagataaccctgcatataatcgatccccaaagagagcaccgcctcgcggatctcttcgttttcaacgtactctgccactaccagcattttcttcattcgcgccaggtggcaaatcgatgccactatctgataatccagactatttgacacaatattgcggataaaactgccgtcaattttaagcagatcggcattcacatttttaagccgcgcatagctggcgtagccggtgccgaaatcatcaatcgcaatctggcagcctaattcctgaagatgctgcaaggtgatttgcgcctgcttaacattggtcagagcattactttcggtgacttcaaaaataagttgccacgcttcaatctgatatttagccagcaactgactgacttcaacaggaaaacgagcctgacataccgaggttggagacagattaatagcaaaacggtgagcgggcatcttcgctctgttttcagccataaattgcagcgtatgctcaatgacccacatgtcgatactcgacgataaaccaaattcgtgcgcgaccggcaagaagctatcggggctgatcagttcatcattctcacctttcatgcgcagaagaatttcatggtaaacatcaccacgcataccggtaatcggctgggccatcaggaaaaaatggttgtgttccagcgcctgctgtagtcgattcatcatcgcgactttatctttcaattcgcgttgcaaatacattgccccgcgacgctgcatattttccggggcgttggtcacgatggaaagttcggcgaccgtatttagctctcccagcagcaggtagatatgattcactggcgagcgcacatagcagtaactgacgccaatctgcggttgcatcggcatgccatcccaaaagaaacgaaattgcttgagatggctatccagtgcggtaatgcgctcctggtgcgattctgtattcagtcgcagcgcgagatcgttacccgaaagctgataaacatcttcacccggttccagcaagggtgacagccagtgagaaagtttttgcttgtattgaatccgcagcatgatgccatagttcttaaccagcatttccatgccagggatgcgtaaataacaaagcgcagaccagggggcatcacgcaacgcgcgattcagggcgcgaacatttggcagatgaaccaccgggtccacatacgcaagccgctgaatgcgtctgactaccgctctctgacgggttgccagtacagccatataattgacaataaaagagaataccagataactggaggaggttatggtcagctgcgtggtatagccaggataaatgggaatgtaattttgatagctgtggatgctgatcatcaacacgaccgcccagagcagcgaaatcagcttataaccatagcgcatcgctccccacatcatcaggggcagcaataatgacaaggtataattggtgctaaaaattgtgcttttttcatttaacggcatgcataacagcaacaataaagcacctaatgccagtagccagagcgcgaactcttttttggtgactttggcatcaacctgctgttttaattgcgaataatagctacgtaaataaaatggatttcgcactacccgaatgatgaagtagcacagcgggacaccgatcagattacccaccagtaaggcctgataattgattaaagtcccgaggttaaaaggcatgacaccgaccagattttctctgctcgccagtaatcctacaaatgcagcaaactggaaaagtatcagaaacagcgttgcaggaaacacaatctgccagaatatacgctgggaaattaaacgggtatcaccatgtgaaacgttgttacgccggggagtaaagaccctgtaaccgccccaacagagaatgataatgataataaaattagccgttaatgatagcgtttcgtaaaaacccagctctgcatatttgcggacaaaaatccctaaggcgatccctggcaatgccgcccagctgaaaaacatcatcatgctgatcatcagtgccagaggcagataaaagagaaaaacctcaccggaagaaatatgcgcgaaagtattaatgtgggcgaaaatgggcaagattaaagaaggcaggaacagcggaagcccccaccatttatcacgtatttttatataagttgcattcagtttcatagatgctcagcagaatcccccacatcctgaaggaggtgtattcagacaggcatcccacctgacttcgaatgatgattattcatcactatagagagcattgattctaagtgtcatatgaaagtaccaattgatatatatcaaacaaaataaccctgattaatgaattattacgtttatcatgttaattcatcattattacatcatcattgtaaataattaaattaacttccataacattaaaatatgtatccactgacgcttttttacataacgaagaattgaccattttgtcctgttgtgccttaatgtaagtaccgtccacagcgtgggacatacttcaaggaaccttttgtgagtcaggcaaccagtatgcgaaaacgacaccgatttaacagtcgcatgacccgtatcgtactgctcatcagctttatcttcttctttggccgttttatctactcgtccgtcggtgcctggcagcaccatcagagcaaaaaagaagctcagcaatccacactctccgtcgaatcaccggtacaacgttagcggttaccttctccactttcacagaacataacggcacttcgctgtcggatgcttttgctgtttgggattatcaaagcggcagatattctttcatcttaaattttacgtctttatcctgactgatgtttatcctgtttggctgcgaaataaatataaaattaatatatatgttgtaatgatatatttttataaattattccctgcgtgaattttaataaatttaatctatccctttatacgcaatacatttactttcctcttttgatgatcttaaatgtcttatttttcgtaatgtgtataacaaggaatagtgatgaaatttaaaaaatgtcttctgcctgtggcaatgttagcgtcattcactctggcaggatgccagtcaaatgctgacgatcatgctgccgatgtttatcaaaccgatcaactgaataccaaacaagaaactaaaaccgttaatattatttccattcttcccgcaaaagttgccgtagacaactcccaaaataaacggaacgcacaagccttcggcgcgcttattggcgcagtcgctggcggtgttatcggccacaacgtcgggtctggcagcaattccggaacgacggcaggtgcagttggcggcggagctgtaggcgcggcagcgggttctatggtgaatgataaaaccttagtggaaggtgtttctttaacctataaggaaggcaccaaagtgtatacctctacccaggtgggtaaagagtgccagtttacgacaggtttagccgttgttattaccacgacgtataacgaaacgcgtattcagccaaataccaaatgtcctgaaaagagctaataatcaggaggagtcatgaagaaagtttttctttgcgccatcttagcctccttaagctatccggctatcgcctcatcattgcaggatcaactctctgctgtcgcagaagcggaacagcaaggtaaaaatgaagagcaaaggcagcatgacgaatgggtcgcggagcgcaacagggaaatccagcaagagaagcaacgtcgcgcaaatgcccaggccgccgctaacaaaagagcggcaacggcagcggcaaataagaaagctcgtcaggataaactggacgccgaagcctctgcggacaaaaaacgcgatcaaagttatgaagatgagctacgcagcttagagattcagaaacaaaaactggcgctggcgaaagaagaagcccgcgttaagcgagaaaacgaatttatcgatcaggaactgaagcacaaagctgcgcaaaccgatgtggtgcaatctgaagctgacgccaacagaaatatgactgaaggcggtcgcgatctgatgaaaagcgtgggcaaagcagaagagaacaaatcggacagctggtttaattaatcgatgttagtaacttcaatcctataattcttgaagataaaaaaccctctgtagtaacagagggttttgttcattcatagtgcagggtcaaatcattcccactcaatggtagctggcggcttgccgctgatgtcatacaccacgcgggaaataccgttcacttcattgataatgcggttggaaacgcgaccgaggaaatcgtacggcagatgcgcccagtgtgcggtcataaagtcgatggtttcgacagcacgcagagagacaacccagtcatacttacgaccatcgcccattacgccaacggaacgtaccggcaggaacacagtgaacgcctggctgactttgtcgtacaggtccgctttacgcagttcttcaatgaagatggcgtcagcacggcgcagcaggtcacagtactctttcttcacttcacccagaacacgaacgccaaggcctggtcccgggaacgggtgacggtacagcatgtcgtacggcaggcccagctccagaccaatcttacgcacttcgtctttgaacagctctttcagcggttcaaccaggcccatcttcatctctttcggcaggccgcccacgttgtggtgagatttgatgacgtgtgctttaccggttgcagacgccgcagattcgataacgtcagggtagatggtgccctgcgccagccacttcacgtcttccagtttcagcgcttcttcatcgaatacttcaacgaaaacgcgaccgatgattttacgttttgcttccggatcgttttcgccagccagcgctgacaggaagcgatcttctgccggtacgtgaacaatgttaagaccaaagtgatcgccaaacatatccagaacctgctctgcttcgttgaggcgcagcaggccgttgtcgacgaatacgcaagtcaggtttttaccgatagcgcggtgcagcagcattgcggttacggaggaatccacaccaccagagaggccgaggatgactttatcgtcgcctacctgctcgcggatgcgagctacagcatcgtcgataattttcgctggcgtccacagggcttcacactggcagatatcacgcacaaaacgctccagcatgcgcataccctggcgggtatgagtcacttccgggtggaactgtacgccatagaagcgtttttcttcgttagccataatggcaaacgggcagctttcggtgctggctacggtgatgaagtcggacggaatagcggtaactttatcgccgtggctcatccagacatcgagcagcggtttaccgtctgcggtcagcgcatcttcgataccgcgaaccagtgcgctgtcgtttacgacttcaacctgcgcgtagccaaattcacgttcgttagaggcttcaacgtgaccgcccaactgcattgccatggtctgcatgccatagcaaacgccgaataccggtacgcctgcttcaaagacatactgcggcgcacgcggactgttttcttcagtagtactttccgggccgccggaaagaataatgccgcttggattgaagtcacgaatttgtgcttctgtcacatcccacgcccacagttcgcagtaaacacccagctcacgcacgcggcgcgcaaccagttgagtgtactgagaaccgaagtccagaatgaggatgcgatgcttatgaatgttttccgtcattgacgcttattccgaggcaagtgaaacagataatataaatcgcccgacatgaagtcgggcgaagagaatcaggagcccagacggtagttcggggactctttagtaatggtcacgtcgtgaacgtggctttcctgaatgcccgcaccgctgatacgtacaaactccgctttagtacgcagttcgtcgatagtaccacagccggtcagacccatacaggagcgcaggccgcccatctgctggtgaatgatctctttcaggcgacctttataggctacgcgaccttcgataccttccggcaccagtttgtcggcagcgttatcgctctggaaataacggtcagaggaacctttggacatcgcgcccagggaacccataccacggtaagatttgtaagaacggccctggtagagttcgatttcacccggagattcttcagtacccgccagcatggaacctaccatcaccgcgcttgcgccagcggcgatagctttggcgatgtcgccggagaagcgaataccgccatcagcgataaccggaataccggtgccttccagggcttctactgcgtcagcaacagcggtaatctgcggaacaccgacgccagtcacgatacgagttgtacagatagagccagggccaatgccgactttaaccgcactgcaaccagcttctgccagagcgcgtgcacctgcagctgttgccacgttgccgccgataatttgcagatccggatatttagcacgggtttcacggatacgttgcagtacaccttctgagtgaccgtgggaggagtcgatcagcagaacgtcaacgcctgcggcaaccagcgcgtcaacacgctcttcgttacccgcacctgcgccaaccgctgcaccaacacgcagacggccttgctcgtctttacaggcgttcggtttacgttccgctttctggaagtctttcacggtgatcatgccgatcaggtggaattcgtcatcaaccaccagcgctttttcaacgcgtttttcgtgcatttttgccagcaccacttcacgggcttcaccttcacgcacggtgaccagacgctctttcggcgtcatgtaaacgctaaccggctggttcaggtcggtaacaaaacgcacgtcacgaccggtgataatacccaccagttcgttttcttcggtaacgaccggatagcccgcaaaaccgttacgctcggtcagttctttcacttcgcgcagcgtcgtggttggcagaacagtctgcggatcagtcaccacaccagattcgtgttttttcacacggcgaacttcttctgcctggcgttcaatggacatgtttttgtggataaagccgataccgccttcctgagccagagcaatagccaggcgcgcttccgttacggtatccattgctgcggaaagcatagggatattcagacgaatagttttcgtcagctgggtgctgaggtcagcagtattcggcagaacggtagagtgagcaggaacgaggagaacgtcgtcaaacgtcagagcttctttagcgatacgtagcatgggcaatatctcgaccagagtggttaataaatattgccgcggcattatacagagcgtaaccgattgcatctacccctttttgcaaaaaatgcttgctatccccgaagggcgggttactatcgactgaataacctgctgatttagaatttgatctcgctcacatgttaccttctcaatcccctgcaatttttaccgttagtcgcctgaatcaaacggttcgtctgctgcttgagcatgagatgggacaggtttggatcagcggcgaaatttctaatttcacgcaaccagcttccggtcactggtactttacactcaaagacgacaccgcccaggtacgctgcgcgatgttccgcaacagcaaccgccgggtgaccttccgcccacagcatgggcaacaagttttagttcgcgccaatattacgctctacgagccgcgcggcgactaccagataatcgttgagagtatgcagccggccggtgaagggctgctgcaacagaagtacgaacagctcaaagcgaagttgcaggctgaaggtttgttcgatcagcaatacaaaaaaccacttccctcccctgcgcattgcgttggtgtgatcacctcaaaaaccggtgctgcgctacatgatattttgcatgtgttaaaacgtcgcgatccttctctgccggtgatcatctaccctgccgccgttcagggcgatgacgcgccggggcaaattgttcgcgccattgaactggcgaatcagcgcaatgagtgcgacgtattgatcgtcgggcgcggcggcggttcgctggaagatttatggagttttaacgacgaacgcgtagcgcgggcgatttttaccagccgcattccggttgtcagcgccgtcgggcatgagacggatgtgaccattgccgattttgttgccgatctgcgtgcgccaacgccgtctgccgccgctgaagtagtgagccgtaatcagcaagagttactgcgccaggtgcaatcgacccgtcaacggctggagatggcgatggattattatctcgccaaccgcacacgtcgctttacgcaaattcatcaccgattacagcaacagcatccgcagctccggctggcacgccagcaaaccatgcttgagcgcctgcaaaagcgaatgagctttgcgctggaaaatcaacttaagcgtaccgggcaacagcagcagcggttaacacagcggctgaatcagcaaaatccacagccgaagattcatcgcgcgcaaacgcgcattcagcaactggaatatcgtttagcagaaaccctgcgcgcacagcttagcgccacgcgtgaacgtttcggtaatgcagtaacgcacctcgaagccgtaagcccactgtcaacgctggcgcgtggatacagcgttactactgctactgacggcaatgtactgaaaaaagtgaagcaagttaaagcgggtgaaatgctaaccacacgtctggaagacggctggatagaaagtgaagtaaaaaacatccagccagtaaaaaaatcgcgtaaaaaggtgcattaagccagcacgaattcaacgcgttttttcgatatcaagccatgcccgtgctgacagaagtaatctactgcaccacaggcttttaacacctgcaacggttgatggcagtctggacaaagagctttcatttcaataaattccccgcaggatcggcaacgcgcatggccgttatcctgatcaagcacatgctgacattgtggacaatgcagttccatatgaattcctccggtagccattccctctacattcatagagggaatggcagataaaatacttacggataattatttatttttcttgatgtgcttcatcagacgcttacgtttacgcatctgggttggcgtcagggtgttacgcttattcgcatacgggttttccccttctttgaactgaatacgaatcggcgatcccattacgtccagcgatttgcggaagtagttcatcaagtagcgcttgtaggaatcaggcaggtctttcacctgattaccgtgaatcaccacaatcggcgggttataaccaccggcgtgggcatatttcagcttcacacgacgaccgcgtaccagcggcggttggtgatcttcaacagccatcgtcatgatgcgcgtcagcatagaggtccccacacgacgggtggagctgtcatacgcttcacgtactgattcaaacaagttaccaacaccactgccgtgcaaggcagagataaagtgcacacgagcaaaatcgataaagcccagacggaagtccagcgtttctttcacctgctctttcacttcctgactcaggccatcccacttattcaccacaatgacaagtgagcgcccactattgagaataaagcccagcagcgagagatcctgatcggaaataccttcgcgcgcatcaatcactaacatcaccacgttggcgtcttcaatggcctgcaacgttttgattacggagaatttctctacagcatcggtgattttgccgcgtttacgtacgccagcggtgtcaatgagcacatactcacgtccatcgcgttccattgggatgtagatgctgtcacgcgtcgtgccaggcatgtcgtaaacaacaacgcgctcttcaccaagaatacggttagtgagtgtagacttacctacgttcggacgacccacaatcgccagtttgatcggcagactttgcgggtcgaagtcgtcttcctcttcttcttcgccgttctcttccgcttcaaattgcgcccagtattcagcgtcttcgtcgacttcctcttgcggtgcgagatcttccatccacggcagcagcacatgctccagcagacttaatacgccacgaccgtgagacgcggcgatcgggtagatttcacctaaaccaagcgagtagaaatcaaccactgcctgatcgggatccagaccgtcagttttgtttgccaccaggaaggtcggtttttcacgggagcgcagatgtttggcaatcgcttcatctgccggcatcaggcccgcgcgcgcatccaccataaacagtacgacgtccgcttcttcaatcgccagcagcgactgttccgccatgcgggtttctacaccgtcttctgtgccatcaatcccgccggtatcaatacagataaactcacggccttcaatttccgcacgaccgtacttacggtcacgagtcagacccgggaaatccgcaaccagcgcatctcgggtgcgagttagacggttaaataacgtggattttcctacgttagggcgcccgacaagcgcgaccacaggtaccatgtttaaagcctcatttttataaatcatcagacaacgcacgctatattcgcgtcgttgttaaaaacaggaaaacggcccctgtccaggagccgttttcaaagtgaacgacagagacgattaacgtgtaatagagtacacggttccgtcttttgcctggatcagcagtttgccgtcagcggcaaccggttcagtctggaaaccggaactatcaactttttgctgggcaacgaaacgaccatcttcgacgttaatccagtgcagataaccttcactgtcaccgaccaccaggttgccattatacagcaccggagaagtcagcaggcgatgcagcagatcgctttgtgtccacagcgtaacgccgccatcaatggtcaacgccatcacccggtcattttgatcgaccagatagatgcgattgccgtcgacgatgaaatcattcaccgaacccagttcgcgtttccacataatctgaccactgcgcagatcaagcgccgtcaggttaccattataggccagcgcgaaaacaacgccgttaacaacgacgggagtcgtgtcaacatcgctcagacggtcaatttcggtagaaccggtcgcctgggaaatacgctgctgccaaatcatctggccctgttccatcagcactgcgctgacgcgaccattatcgccccccacgacggccgcaccaaaagccgttgtcggcgcagactcgccacgcaaagagagcgaaggcatatcgaggttaactgtccatttgacagcgccgtcagcttcgttcagcgcttgtaactgaccgttactggtgtggattaacaccagaccgtcgctgaccaccgggcgcgaaagtgcttcacccgcgactttagtttgccatgccacagtaccatcgctggtattcagcgcgtaaacctgcgccttttcgctgccaatgtagacatgcccaccagacacggtcacaccgccagaaagtaatgcaggctctttagagaaccagccatctttctcggccaggctgacagaccagatttctttgccatcatccgcattcagcgcttttactaaaccagcgcggtccgctgcatagacaacgttgtccgccagtgccggatgaagattggaatagaagttgccaatgccgctaccaacggaagtgctccacgccgtggtcggcgtaaactggttttcaacggttggcaatggggacatctttaccacatcttcttcgctgttaaacagcgaacagccgcttaaaagggtaacggaaagcagtcctggcagcagtaatttacgcaattgcatcgggtccctctcagatggacaaattattaattttcatctgcatcatttcgctcagtgccggagtaacatcgcttttcacgcctgcttcccatgcactacgcgcaccttgcttatcacctttgctcagcaatgcttcaccacgcaggtcggcaacaatggcagcccacccttcacctttgatggtatcaagggttttcagcgcggcatcagcctgcttgagctgtacctgaacgcgagcaagacgcagatttatcacggctttgagattttcatcgctcgtgtctgccagcccctgttgtaactgggcggcagctttctctagttcatttttgtcaacaaattgctgcgcaagttccaaagaagccagcgcaccataagtatttttattttcagcagcaaatttttccgccgccgggatgctatccggtttgccttcgctcactgcggtaaccgcattttgataggcaagagaagcggagcgtgcagaatcaacctgatggctgttccagtagcgccagccaatcagtgcgccaacgcccaaaatcaccccaacagccagtgctttgccattttcagcaaaaaagcgtttaaccgcttctacctggtcgttttcgttctcgtaaatttccacgctgtccttctccttccttaacccagtaacgtgcgcaaatgcgcggctacgctatcctgcgcaactgccgtttgctcaccagagcgcaaatccttcactactgctgtgccgttagccacttcagactcacccagcaccacagcaacgcgggcaccccatttatcagcacgggcaaactgtttcttaaagttgccgccgccgtggttggtcatcaatttcacgcccggtaattcatcacgcagacgctcagctaatgccatagccgcagattgtgtatcagcacctgaagccaccaggtatatatcgacaacaggatcggctttaaattccggattaacggcctgtactaacaatacaagacgttcgaggcccatagcaaaaccgacagccggtgttgcacgaccgcccagttgttccacaagaccgtcataacgaccgcctgcacacacggtgccctgggagccgagactgttagtcacccactcgaaaacggtacggttgtagtaatccagaccacgcaccagacgctggtttacggtgtaagcgatccccgcgctctccagcagtttgcacagaccggcaaaatgctcacgagattcctcgtccagatagtcacctaatgccggagcgtcgttgagaagcgcctgcacttccggattttttgaatccagcacgcgcagcgggttagtgtacatgcggcgtttgcagtcttcgtccagcttttctttatgctgctcaaggaatgccaccagcgcatcgcggtaattggcgcgtgcttccagcgaaccgatagagttcagctcaagagttacgtgctcggaaatacccagcgcgcgccaccagcgggcagtgagcataatcagttcagcgtcgatatccggaccttgcagaccgaaaacttcgcagcccaactgatggaactgacgataacgccctttctgcggacgctcgtgacggaacatcggcccgatataccacagacgctgttcctgattgtacagaagaccatgctcgatgccggcgcgtacacagcccgccgtcccttcagggcgcagagtcaggctgtcgccattgcgatcctcaaaggtgtacatctctttttcaaccacgtcggtgacttcaccaatcgcacgtttgaatagcggggtctgctctacaatcggcaagcggatttcactgtaaccgtagctgccgagcacgtttttcagtgtgccttcaatgcgctgccagatggccgtttcgccaggcaggtaatcgttcatgccgcgaatggcttgaatgttttttgccacgtttattctctttctgaatataaaaatgaaccctcaacgcttccctcaatgtttcgggagccatgcgggttcaatcatacacgggaagcgaggcgcttcccatcacgttattatttttcaacctgctgaacgtcaattcgacgcgcttcgtccagctgactggctttcgcacgaatgcgtgcttccagctggtcgatcatatcgttgttgtccagacggtctttgcgcacgccatcttcatagaggccgcttttcttgttgccgccggtgacgccgagtgtagaaaccagcgcctcacctgggccattcaccacgcagccgataatcgaaacgtccatcggagtgatgatatcttccaggcgttgctccagcgcgttaaccgtaccgataacatcaaattcctgacgcgaacaggtcgggcaggcgatgaagttgatccctcgcgaacggatacgcagcgatttcaaaatatcgaaaccgactttgatctcttcgaccggatcggccgccagcgatacgcgcagcgtgtcgccgatgccttcagacagcagcagacctaaaccaatggcggattttactgccccgctgcgcgcaccaccggcttcggtgatccccagatgcaacggctgatcgatctgttttgccagcaaacgataagactcaacagcgaggaagacgtcagacgctttcacgctgactttgaactgatcgaagttcaggcgatcgagatgatcaacatgacgcatggcagattccagcaacgcctgcggcgtcggttcgccatacttttcttgcagatctttttccagcgatccggcgttaacgccaatacggatcggaatgtttttatcgcgcgcacagtcaaccaccatgcgaatacgctcttcattaccgatattgccagggttaatacgcagacaatcgacgccgtattccgctactttcagcgcaatgcgatagtcgaagtggatgtcagccaccagcggcacgttaacctgctgtttgatgagtttgaacgcttctgccgcgtccatcgtcggtacggatacacggacgatatcagcgccaacgcgttccagcgccttgatttgattgaccgttgcttcgacgtctgtcgtacgcgtattggtcatggactgtacggcgatgggagcaccatcgccaatcggcacattcccaacgtaaatacgtgttgattttctacgttgaattggagcctggttatgcatgaaaaatctcccgcgttacccgtctgttactgcgccggtgattgttcggcattgagggtcagacgcgcaacctggttagttctgataaaacgactcagatcgacaggtttcccttgatactggatctgtactgcggctggcgcaccaattttcagtttgtacggtgcctggccggttaagttcaaattaccgtctttacgctgcataccgctaaacaattttttaccggtagcatcagtgacctccagccagcaatcggcagtaaagttcatcaccagcgcattcggatcagccaccggcgtggtcacgccagcctgatcggttggcaacggcgcagcaccatctggcgttgttgctgccgttggtgccggggtcgcggcggtatcaacatttgcctgcgaaggcgaaacaaccgcattctgttgcggatcaacagctggtgctggcgcagttacggcaggtgtttgcgtgttggttgcggtagtatccacagacgctggcggcgtggacgttgtagccgggtctgtagttgtcgacgtatttaatggaacactctgcccctgctcgctattactgctcagttccgccgaagattgatcggccatagtggtgatctcttcctgctgagctttgcggtcttgccaccaccaggcaccgctcaggccgataaccacaaacaacaccagccaagtgaaggtcatcagccagccgtcgcgttttttgcggcgtttaccgagggaaaaactctgcatcggcgcaacttttgcagcccgaagtggagcctgcttttccagccctggcagcagttcttcttctggaatatgtaccagacgcgcataagagcggatatatccgcgcaggaatgttgaagcaagatcggcgggtgccttatcttcttcaatgtcgcgtaccgtggaaaccttcaggcaaagtcgctcggcaacggcctgctgactaagtcctagttgttcgcgagcattacgcaggcgagcgccggtagtaagtgcttcattttggtcgtgcgtggcttcagtattcattcgctgcaggtacgtttaaatgagaattgagatgccggtgaaccatcatgctcacccacaccgcgaaacatccgttaagttaaccgttatcatacagtataagaccgtctgtgtgctcgtgacaaagcccacattcactaaggctaacttactgttgcatcgttacatactgccttaaagtcagcaaaaacgcaccgttaatattgaccagacaattgcaacttaatacttcattcataaaacattacgccacggtacataaagtaaccgtggcgtaatggctatcagaccgctttaatgtcgatggcttcaccctgcatccgtttacgcagggtacgtttcgtacggtcgataacatcgcccgccaactgaccacaggcagcatcgatatcatcaccacgagttttacgcacaatagtggtgaaaccgtagctcatcagcacttttgagaaacggtcgatacggctgttcgagctgcgtccatacggcgcacccgggaacgggttccacgggatcaggttgatcttacacggcgtatctttcagcagttccgccagttggtgcgcgtgttcagtgccgtcgttaacgtggtcaagcatcacgtattcaatagtgactcggccctgattggcgttggatttctccagataacggcgcaccgcagcaaggaacgtttcgatattgtactttttgttgatcggcacaatttcgtcacgaatttcgtcgttcggcgcgtgcagggaaattgccagtgcaacgtcgatcatatcgcccagtttatccagcgccggaactacaccggaagtggaaagcgtgacgcgacgtttagacaggccaaaaccgaaatcatcaagcatgatttccatcgccggaacgacgttgttcaggttgagcagcggctcgcccatgcccatcatcactacgttagtgatcggacgctgaccggtgacttttgctgcgccgacgattttcgccgcacgccacacctggccgataatttccgacacccgcaggttgcggttaaagccctgctgggcggtggaacagaatttacactccagcgcacaccccacctgcgaagagacgcagagcgtggcacggtcgtcttccgggatatacaccgtttcgacgcgctgatcgccaacggcgatcgcccatttaatggtgccgtcagatgaacgctgttcttcaaccacttccggtgcgcggatttccgccacctctttcagtttgccgcgcaacactttgttgatgtcggtcatctcatcaaagttgtcgcagcaatagtgatacatccacttcatcacctgatcggcgcggaagggtttttcacctaaatctttaaaaaactcccgcatctgctgacggttgagatccagcaggttgatttttccatctttcgtggtgacgttttcaggtgtgactaattgttcagacatatgctattccggcctcgttattacacgttatggcccctggagggttgaaaaaagaaacgccccggtgagcggctgctcgtccgggggcgctgcattgtacaaattctggcgcacggatgccacgtttgcacgcggcatttacgaaattattaacgggtgcgcgggcacacttcgccttcgccaaagaaataagcgatttcgcgagcggcagattcgacggaatcagaaccgtgggtaccgttttcggtcaggctgtcagcgtaatcagcgcgcagagtaccagccagtgcgtttgccggattggtcgcgcccagcagatcgcggtgacgctgaacggcgttttcaccttccagcacggaaaccacgatcgggccagaggtcatgaattcaaccagaccatcaaagaacggttttccatcgtgttcagcataaaagccacgtgcctgttcaacggtcaggtgcagcattttggtgccaacaattttgaaccctgcagcttcaaagcgcgcaaagatattaccaatgacgttttttgctaccgcgttcggtttgatgatggaaaaagtacgttcaatagccatttttacctctgtaaattgttctgttgttgtctgtaccagcgtacgagatggcgcggattataatgagcaacagggccgttgactattgatgaaggtaacatttttttaaaataaaatgagttttagcaacaatcagggacaaaacagactattgcatgacaaatttcactgtcgcgatttgccccacgtcatccatcaccagcaattgataatcacctttatccgtcaaatgcagggtcacgttgcgcccgcgttcagttaacggttcgccattcagaaaccaccagcgttcacctgcccctccacttgattgcaacggcaaagtcgcttccgctgcgcccggtaaacgtttaataatcgcgccatcgcgaacgcctgtcagctgcagcgggagctgggcatcgtgaccgtatggcgggcaacttgtcgaggccggtggtaagcgcacagcgcgacgttctgatgcgggcagccagggttccagcggtagcggccagacatttatcatttcttgtcgcgcttgcgggcaatcagcggcaacacgtttgccattttcatccagccagatggggaaacgaatgccattaatgccttcctgctccggcagtaatagagttggcggctgactcccgtccagcagccaggttgccaggcggcggcgacagttaccgtcaccttccggcaaagactgtccgcccggccagcagataacgccacgagtgactgagttcgggcgcgggtcttccggcagattcgcactgcgcgacagtaagatattattgacctgattcaacaatggtacggcactggcaaagccaaactgaccaacaacgggcgtgccgtccggtctgccagtccagatcccaatgacatagcgagcgttaaccccaatcgcccaggcgtcacgatagccatagctggtgcccgttttccatgccagtggggcgacgcgcggcaaggcactatccggcaagggttgcgcttcatcagccataatccggcgaatgatccacgccgcccccgacgacattaaaggccgttcaagcagcggatcgtcaggctgtaagcgcaatttgcctgccttgccgtggcgagcaaacgcggtatacgctgccgccatatcttccagttttgcaccagcgccgccgagaatgagtgaaagattcggcgcagcaccgttgggcaaatataacggcaatccaacattgcgtaactttgccgcaaaccgtttcggtccataggcttccagcacctgcacagcaggtaagttcagcgagcgcaccagcgcctcgctcatgctgatcgggccatgaaaaccgctatcaaagttacctggtcgataatcaccggtgcgccgggggacgtcttgcagcagtgatgccgggtggatcaagccttcatccagcgccagaccataaacaaacggtttgagcactgatcctggcgatcggatcgaattgaccatatcaacatgaccaaagcgtgaatcatcgttgagatcaaccgatcccacccagccgcgaacacgcatatcggtatgatcaaccacgatcatcgccagtgagctgcgcggtggcaaccgccctttccagttttgcgccagttcttccagacgtcgttgaagaccggcatccaacgtagtagtgattttgtcgcttttgcttttaccgagcatcatgcgcgaaaacagcggtgccagttgcggcatttgtcggggggccagccagatgggttcttcccttgactcttttacctgctcacgggaccacacaccttgcacggccatccgttcgagcactttattacgcgcggcttcggcacgctccggccaacgatccgggcgaagacggctgggcgcttgcggcaaaaccgccagcattgccgcctcggaatagcttaaattcgcaggcgattttccgagataagcccaacttgccgcaccgatcccctgcaacgtaccgccaaacggagcgcggttaagatacaaggtcagaatttcacgcttagacagatgccattccagttgcaacgcgcgccagagctggcgaattttgccgccaaatgttttggggtgaggatcaagcagacgagcaacctgcatagtgagcgtgctgccaccggaaataacccgtcccgaagtgagatcttgccatgctgcgcgcgccaccgagaatggattcacccccggatgcttccagaaccagcgatcttcataattgatcagcgcttcaaggtaacgtggagaaacatcttcgattgttaccggataacgccagatgccgtcagcatcggcgaagcgccagagcggcgtaccatcctgcgccacgaccactcgtgcgggattgacttcatgcagcggtagaggccagagtttatctgctccccacgctgcaagaaaaaggagaaagggcgcggctgccaacgttatccagcagccgcgtttggttaacaagcgaggcatttacggtctgacaatcagcagatcttcagccgcgccggtcgcccgccattggggaacatacattgattccaccatcggttgcggtacctgatacgttcccggcgtcaccgcccgcgccagatacaccagcgttaccggttggtattcatcaacggcaaccgccgccacaaagcgatcgtcacggaactcaatgtgcttaatgctcgcctgctgcatctggttcagtaagttctgcacttcgccaccactttgctccaggctggcgctaccgttcgccagattctggttttccagttccagacccgcaggcagcagatccacgactaacgcatccggcacgctgttactggcttttacctgcaaccacaccagcaccagatcgccgctacgtaacgagtccagcgatttgctcttaccatcagtaccaagaatatgacgctcgatttgcagcacattgttcgccggtaaaggtgcggattgcggataaccgctggcatccatacgcaaccataacggctgatcgccactgttgctcacctgcaaggtgacaagttgatcgctattcagattgctgttttgcgctttctcgcctgtcagctgctcagctgagaaagaggtttgcgcctgccatttaccgggtaaatcctgaatcgtacgggcagccaggaacaacgcgttactttcctgcgtcgatagccagcgttcaccaaacgcctgctgcgaaagtgtgttcagcaaagtgtactgctcatcgggtagcagtttattttcttccagcaaggagagcattaacgcgttgtcgcgcagtgaactaccgtaatcacccagccatatccgctcatcactattacgcggcgttttcagcgccagcgcaatcgcttcttcaccacgcgtcgcatcacccatggttttcagcgcaacgccaagttgcagcagcggtaaaccagaagcggcatctgcacgatgctcccagatttcacgcagcgcacccagcggagccttttgctgacgggccaacaccagcgcagcgtaagactgtacggcgaatttactggctttgagattatccgcgtacgggatcgacatcatgcccggatcttgtaaatagcgcagcagacgctcattaccccggttaatggcgtctgtcggcacgctgtaaccctgttcgcctgcgcggaccaggaaatccatcacgtaagccgtcagccagtactcttcgtcaccgtttttatcccacagcgcaaagccgccgttatcacgttgcatttgcagcaaacgggaaatgccgatatcgaccgatgcacggcgtttctcatcactgtcgcctttgatgcccaacgcctgcagttgggctgcgttggtataaagtgacggaaacaggccgctggcggtttgctcaagacagccgtacggatacgcttttaactctttgatataacgtgcgatgttcagcggtggtttgccgctcaacaacaattgcccttccagcgtaacaggcgagaagttttgcaatccatccgccggaatcgcccatgtctcaccaggctgtaacgccgtaccgtaattaaccgtttgtgccgggaacgccggacggacgccgattttccactgcttatgctgatcggcaacggtttcacccggtaacgctaacccgctaatggtggcctgaatttctccatcgccataacccggcaatgctcgcaccgggataaacagcgtagtacgcacacctggcgctaattcaacggctgcgggtgaatcgctgaccagttcaagcaaaccactggcggtcagggcaacgttcagtttttgcggtttatcggtaagattagtgatatccagcgtcagacgcgaggtatcgccactcgccataaagcgcggcatgttcagttcagcaatcaccggtgcggcaactatcactttactttcgttgctaccgaagtcatctgccgtccaggcttgcgccatgacgcgcaattcaccgttaaaatcgccaatcggcagtgtaaccgagccttcgccctgttcgttgagcgttaccggcagcgcctgctgcacgacaatattgacgtgattgaccggcggtttaccaccacgtttcagctcatcaccatcgccaccgaaacgcagagctgccagacgcccctgaccttcaataacctgaccgtaaatatcgtaaatgtctgcgccatagcgtttctgaccaaagaacgcctgccacggatctggcgtgacgtagtcagtaatattcagcacaccactatcaacggcagacaccagcacattcacctgtttaggcttctcgccatttttagtgctggctttaattttcacggttaatggttgattgggacgcatttttgctggtgtttccagcgccagatcgaggcgacggttttcatcgccaagcggcagatgcaacacaccaaccgcgcgttttggcgtcgcggagcgagatttatcgccaggacgtaccaccagcgtacttaaatacagatcatgacgattccaggttttatcgaccggaatcgtcagatccagcccttgagcccgaacatcaatctcttgccaccacagcggcccttcactggactcgaccatcgcataacctttacccgccgttggcgcggcgatatgcaacttaatggtgtcgccagggcgataactggctttatccagtttcagcgtgacacggtcgggtcgcactgcgccgctaccgtcgctgttgtcctgccagctatagccagcccagaaacgaacactactgaccgcttcattcggcgctttgacttccagacgataagcgccccactctaccggaaaactgaccttgccggtttcgtccgctttcagatccagagtttgttcattttcgatcagatctttttgatcaaactgtgactgccagccttcatcttctgaccagttccagtagtaatcgcggcgttcgcgaatcaggcgcacctgcaagcccgacacggcttttttcacgccttgcgcatcgctataaacgatgtcaaaagcggcgttactgccttcatcaacaatgggctgtttcaccgtgctgtcagtacgataatcgtaaaccgatttcgaggcgaactgcggacggatccccggcaatgcatcggcaggccagatagcctgctcagcgcggcgcgtcaccgggcgaccgcccgattccagcaaactaccctggaaaataacctgtaatggggaatgcgtttccttccactggctttctgtagaaacttcgccgcgccctttatcatccagcgtcaactgaacttcatccagcgtgcgggaaagattttcggcagctatatcgccgaattcaaaaccaggtaaggctgacacagcttcacgcagtgggcgcaggaaaagttgcccttgcaaagtattaccattagcaggtgcaccatacaggtagtaccccaccacggagaatttcacttcatctttcggcgttagcggggttttctcaccggtcagattcagcgccatgcgctctggcataaaatcttcgacgtggaaatcccacatccgatactgattatcgcccgtgttagcgcgaatatgccacataccggttgccgcattgctatcgagtggccaggtaaagtggtagaggccattctccggctgactaacgacgctcctgagtacctgcccatcgggtttaatcacgtctaacttgatgggttgattgggcaacgctttaccgtctgcatcacgcagcaaaccattgaggattaccgtttcacctgggcgataaagatcgcgtgggccaaacatgaaaaactgtttgctatagcctggcgcgccagcaatgttaaattctgctaagtccagcgccggaagttttaaatcgagtagcgttgtctgaccgtctttacgcgccaacagtaatgccgcgtttttatcattttccagctgcacatgcccctgagcgtcactggttgcctgagtcagagtctgccctttctcatttaataaagagacttcaattccttgctgggccgcgccgttttccagactttgggtaaagatatccagacgattgtgataacggtgagctgaaacgccgatatcacttaacgtaaacagcgtcgcgggattactgtaatcgtaacgtccagcctgattcatcacagccagatacacgcccgcctgctgaagcggtttgatatcgcccagcggcagcaataatttttcacgggtgttacgcgcaggattgagatcaaaccgtccggtgtagaccagatccgccatctgcagcagtttgtctgactgccagttcgccagcgaattgcggtattcccattggctaatgaatgctggcagagattctggcttaacgcggaagaagttaacatcgacattattaacgttgagcgccattaccggcagcccttcaacgactttgccaggcagcagcgaaccacggctggcaaaaccgacgctgggttggatgtcgcgggtagttatagttttttcgtaatctttactgaaggttgcgttgttgagtgctttgacctccttgccaatagtaacgatcaaatcacgtttcggttcgaggtggcgtaaacgtaactctttaagattatctgacagctcccaggcaccatccactttgccgctttttttatcgacgacatgaataacgcgtgagaaatcctgatccgggtcgagagggatggagaacgtcagcaccagcgtggctgcaccatcaagttggacttcagagagatccagcaatgtcagcaccttaccggcactctgttgggccagtttttgtctctccggcacggagagttttgctgaactcgcgttttctgaagaggccgctttagtaacttcagaaggcgcatcttttttcaccgctgttggcgcgttatcgttgttgtcgcaccctgccagcgccagcattagcatgcaggcggctacgcgtaactttttcatttttcatccctgccacaatggcccgttagcaacgtcgaataattattatgcgtgagaatttacgttatgtaattcagtatcacgcccatacaatccgaattttagtgagaattgtggctcagacagccaaatcagcctcttttgcttgtcgcttttcactaaacatccgacaatttagcctaaccccggcaaaaatggagatgcctatgtccacgacatggtttgtaggagccgactggctcgccgaacatattgatgacccggaaattcagattatcgatgcccgcatggcgtcgcctggacaggaggatcgtaacgttgctcaggagtatctgaatggacatattcccggcgcagtgttttttgatatcgaagcgctttctgatcacacttccccgcttccgcacatgctgccgcgcccggaaacgttcgccgtggcgatgcgtgaattaggcgttaaccaggataagcacctgattgtctatgacgaaggtaatcttttctcagccccacgagcatggtggatgctgcgcacctttggtgtagagaaagtgtcgattctggggggtggacttgcaggctggcagcgcgatgatctgctgttagaagaaggtgcagtagagctgccggaaggagagtttaacgccgcgtttaatcctgaagccgtggtgaaagtaaccgatgtattattggcaagccatgaaaatacggcgcaaattattgatgcccgcccggctgcacgttttaacgcagaagttgatgaacctcgcccaggtttacgtcgcggacatattcccggagcactgaatgttccgtggacggaactggtgcgcgaaggcgaactaaaaacgaccgatgaactggatgcgatattttttggtcgcggcgtcagctacgacaaaccaattatcgtcagctgcggctctggtgtaacggcagccgtggttttgttagcactcgcgacgctggatgtgccaaacgtgaaactgtacgacggcgcatggagtgaatggggcgcgcgggcagatttaccggttgagccagtgaaataagtattttacaggcaataaaaaaccgccgaatttggcggttttttattgctagtctggttcgcggcctttccagcaggttgacttgtgttacatgagcaacgcaggtgcttcacagcaaaacaatactcaccagtaactctctttttgtcaagcaaaagagagtaattattgtttatttagcgtattatcgacaccggccctttccgccgtgttcggtaataaaataacctggcttattagtccgaattcagacaaatataaataaatcctgctcaaaattaaaaattctaaccggtaaaagatattacttaaacatgtaaattcactttcctttaaaaaacaaaaaaccgccaaaatcaggcggttttttgttgctggtccggttcgcggcctttccagcaggttgtattaccgtagtaatgcaagcgcgtctcagcggagacaatactcgccagtaactctctttttgtcaagcaaaagagagttattattgttctgttagtgtattatccactgcggccctttccgccgtctcgcaaacgggcgctggctttaggaaaggatgttccgtggccgtaaatgcaggtgtttcacagcgcttgctatcgcggcaatatcgccagtggtgctgtcgtgatgcggtcttcgcatggaccgcacaatgaagatacggtgcttttgtatcgtacttattgtttctggtgcgctgttaaccgaggtaaataataaccggagtctctccggcgacaatttactggtggttaacaaccttcagagcagcaagtaagcccgaatgccgccctttgggcggcatattttagattatccgattctgtttaaagtcacgcaaaaaaccaccccagcgacgttcatagaatggcgcaatatgttcggtaataaagtggctaattcctttttccccttttttcacctgacaaatatcgattggttcatcgccaggtaatgtatcggtcgctacacttcccgtcgcctgaataatttcttcgatatcaccatcggcttcaatgccaataagtaaattaggctgtgcctcttcgttctctttaattgaacaaataaaagcacgcttcaccggcttaatggttttaaataaggtggtgagtgaatcaatcatttgtgctggcggctctgcgacttccgataatatcagcgattcaccgccttccaggatttcctggctgctcagcggatttccctcttcaccaatcaacaaactgatttcacgcggcataaattctttaccggttggcagtttggcattaaggaagagcgtttcgccaagtgtcatctcaaacagcgtgcgaacgggcattacgacaaatgcctgttcgtcttcaaccgcctgttgaagtgcttctaacgaggtgaaaaaaggaatgacgctggtgccgtcttctttttcccagtgctgtaaatcaagcgcgctatcttcaaccacagcctcgccctgcgccgccgtaccaggcacccagacggtggattccagtagagtacggaaaaaggccgggcggtgcgccggttcagttgctgctttttccagcaggtcttcaagttcgttttttgtttcggacataagaaccacaattcattcaacgttcggggcgcaaatgcctgatgcgctacgcttatcaggcctacaagggattcgcaatttgttgaatttgcagaatttgtaggccggataaggcgtttacgccgcatccggcatattagtttacgccgttaacagattagctatcgtgcgcacaccaagtcccgtagcgcccgcagaccactgttcaaccggcgctttacggtaagtcgccgagcagtcgatatgcagccagccttgctgatagttctcaacaaagtgcgacaggaagcccgccgccgtgctcgcgcctgccggatacgccgcgcttccggtattgttcagttcggcaaagttagacggcagctggctgcggtggaactccgccagcggcagacgccagaacggttcgttctcctgcgcggcactcgccagcaagcgaccggccagcgcatcgtcaaaactgaacagcgcgtgataatcattacccagcgcagttttcgccgccccggtgagggtcgccgcatcaatgatcatttccggtttctgcgcactggcatcaatcagaccatcggcaagcaccagacgcccttcggcatcagtgttcatcacttcaacttttttaccgttgcgataggtgatgatatcgcccagcttgaacgcattgccgctaatcaggttatccgcacagcagaggaacagcttcacgcgcttgttcagtccgcgcgtaatggcaaatgccagcgccccggtaaccgttgccgcgccgcccatgtccgacttcatcgagtccataaacgcagtctgtttgatgctgtagccgccggagtcaaaagtgatacctttacctaccaggcacgcgtacactggcgcttctttatcgccagttgggttgtaatccagcgccagcaataccggagaacgttctgaaccgcgtccgactgtgtgcagccccatataaccttgctcacgcagatcttcgcctttggtgatccgataagtcacacgatcgcccgcgacgttgctgatcagatcaacagcacgctgtgccagttgcgatggtcccaattcttctgccggtgcgttgatggtgtcacgcacccagtcgatgatcatcaggcggttatccagttcctggcgctgggcatcgtccagatccggccacaccactttacgcgtgcctttcggggctttgtaaccttgccagaatgcccagcagcgatccgcatcccagccttcaccgcttaactgaacatgcttgatgcccagaccgtcaatcttgcgcgccgcacgctggatcagccccagatcgtctgccccgttcaaatgcagggtaatgccgtcattattaatgctgtaagttgctttttctccccagcgcgcgtcggcaggttgggtagagagggtaatcttcatcgcttctgtcattttagttatccttctttgtaaaagggccgccagttggcagccccaggatttttccgctaaatgattcgcgttgcaggaaggcggcaagtgagtgaagccccaggagcatagataactatgtgactggggtgaacgagcgcagccaacgcatctgcggcgtgaagcatgacgcggaaattattcggcctcgtccagccagactaacaaaatcgcttcgaggattttctcgttggatgcctgcgggtcgtcgtcgaaatcttccagatcgcaaatccactgatgcatatcggtgaatcgaaccgttttcggatcaagatcgggatacgcatcgtacagtgcttcgccaatttcgcggctatcggtccacttaagtcccatactaacctctgttaatgctcacgcgcatggttgatagtgtaacgcgggatttcgactactaaatcttcgtcggtaacgcgcgcctggcagcttaaacggctttccggctccagtccccaggctttgtccagcatgtcgtcttcctgctctgagctttccggcagtgagtcaaaaccttcacgaacgatgcagtggcaggtggtgcaagcacaggatttttcacaggcgtgttcaatctcgataccgttacgcagagctgcgtcgagaatggtttcaccgctattagcttccagaacagcgccatcagggcagagatcctgatgaggcaaaataacaatctttggcatattaaacctcgtccacggaatggcctttcagcgcacgacgaaccgactggtccatgcggcgagcggcgaaatcctgggtttgtttgtctacgtttttaatcgcttgttcgatggcgtcaacatcatcgccctgcgccacttcactcaggtgagcggcagcatcgtcaatgacctgacgttctgcggcgcttaacagcgcggcatcagcagccagcgcgccgtgcagactttccagcacacgcgccgcttctactttttgttctgccagcattcgggcttttacgtcctgctcggcatagctcattgagtctttgatcatcgaagcgatttcgctatcggtcagaccgtaagacggtttgacctgaatagacgcctcaacgccggtggatttctccatcgccgtcacgctcaaaagaccgtcggcatcgacctggaacgtcacgcgaatatgcgcaccgccagccggtagcgccggaataccacgcagcgcaaaacgcgccagtgagcggcagtcctgcaccagttcgcgctcaccctgcattacatggatagacatcgccgtctgaccatctttaaaggtggtgaaatcctgagcgcgggccaccggaatagtggtattacgcggaatcactttctccaccaggccgcccatcgtttcgaggcccagcgacagtgggatcacatcaagcaacagcatttcgctgtctggcttgttacccaccagaatatccgcctgaatcgccgcgccaatagcgacgactttatccgggtcgatggaagtcagcggtggacgaccgaaaaattcgcctacccgttcacgcaccagcggcacgcgagtagaaccgcccaccatcaccacttccagcacttcatcagcttctacacccgcgtctttcagcgcgcgacgacaagccagtaaggttcgttttaccagtggcgcgatcagttcattgaattgttcacggctgatttcgccctgccagcccgcaacgttaacggtcacggagtccgcatcgctcagcgcgattttggctgcaatggcggcatccagcagttcacgctgaacgcggttatcgctacgatcaggaatgcccgcctgctcgcgaatgtaatccgccagcagatggtcgaaatcatcgccgccgagcgcggaatcaccgccggttgccagcacttcaaacacgccgcgacttaagcgcagaatggaaatatcaaacgtcccgccaccgaggtcataaacggcgatcacgccttcctgaccggaatccagcccgtaggcgatagccgcagcggtcggttcgttaagtaagcgcaggacgtgaaggcccgccagacgcgccgcgtctttggtgccctgacgctgggcatcgtcaaagtacgccggaacggtgataactacaccatccagctcgcctgccagggcttcagttgcccgcgccgccagtgctttgaggatgtccgcagaaacgcgcaccgggttcagcagccccgccgccgtttcaatcatcggcaggccgttttcgctggcctggaattgataaggcagatgcggatagcgttgctggatatcagccagcgagcgtcccatcaggcgtttaacagaactaattgtgttggcggtatcgagcgctgcattagtacgcgcgtcataacccaccgaatgcccttgctgttgatagtgaacaacagatggcagcaggtgacggccttcatgatcggctaacgtttcggcctgaccgctgcgcactgtcgccaccagcgagttggttgtgcccaggtcaataccggccgccagacgacgctgatgcggcgcagcactcaaaccaggttcactaatttgtaataaggccatgtttagcttccagaaattaaaaatcgagcagtttttcttcgagttgttcggcactgcttcgcagtttatcgagaaaacgcagcttacgcacggtatccgccgccgcgtcccacgtctcgttgtctaactgttcaaccatcaactgatggcgggtatcaaacatctttttcacacgtttgataaagctttccagccgcgcttcatctttcgcctgttcgatctcgtccagctcttcgcgcagctccaactgttccatcaggaacgcggtgtcgcgcacagtatgctgctcgctggcgagatcaaagccgtgcaaagaaagcaaatattccgcgcgcattaacggatgacgcagcgtttgccaggcctggttaatggttgcagattgctgtacggcggcgagttgttccgcctggcttccgctggcgaatttatcaggatgatactgacgttgtagatcctgaaaacgcaggctcagcgcctgggtatcgagttgatagcgggcaggcaagccaaagagggtgaagtaatccataacattctcagggctgcgatccgccgcgataacggcgaatcaggtaaaacaaaccccacgcgcaggcgaccacggtggggttatcggtatgcgcatcaaacgtggaagctttcgccgcaaccacactcatctttgacgttcgggttggtgaatttaaacccttcgttcaggccttcttttacgaagtccagctgcgtaccgtccagaaattgcaggctcttgccatcgaccacgactttcacgcctttgtcttcaaacacgatgtcttccggcgtcggttcgtcaacaaattccagtacataagccatacctgaacacccggaggttctcacgcccagacgcaggccaaaccctttaccgcggttagccagaaaggtatttactcgcgctgctgcactgtcgctcagtgtaatcgacataaccaaacctcaactcttattttgcttcacgtttgcttttatagtccgcaatggcggctttgatcgcgtcttctgccagaatagaacagtgaattttcaccggcggcagttcaagttcttcagcaatatcggtgtttttgatcgcctgcgcttcgtcgagagacttccctttcacccattcggtgaccagggagctggaagcgatagcggaaccgcagccgtaagttttaaaacgcgcgtcttcaatgataccttcatcgttgactttaatctgcaacttcatcacgtcgccacaggccggtgcccccaccatgccgctgccgacgttctcgtcgttgttgtcaaaggaacccacgttacgcggattctcgtaatggtcgataactttttcgctgtaagccattataaattctcctgattccgataccgattaatgatgagcccattcgatgctgttcagatccacgccctgcttgtacatttcccacagcggagaaaggtcacgcagacgaccgatggatttacgaactaactcgatggtgtagtcgatctcttcttcagtagtaaaacgacctaaagagaaacggatagagctatgtgccagctcgtcgttcagccccagcgcgcgcagcacgtaggacggttcgaggcttgctgacgtacaggcggaacctgaagaaactgcgaggtctttcagcgccataatcagcgactcaccttcaacgtagttgaagctgacgttgagaatgttcggcgcaccgtgttccaggtcaccgttcaggtaaacttcttcgatatctttgatgccgttccacagacggttacgcaggccgcgcagacgttccatctcggtcgccatctcttcttttgcgatgcgataggcctcgcccattccgacgatctggtgaacaggcagagtgccggaacgcataccgcgctcgtgaccgccgccgtgcatttgcgcttcgatgcgtacgcgcggtttacgacgtacatacagcgcaccgatacctttcgggccatagattttgtgaccggagaaagacatcaggtcaactttcaactggctcaggtcgataggcagtttacccacgctctgggttgcatcaacgtgatagataatgccacgagcacggcacatttcgccgatagccgcgatatcctgcaccacgccgatttcgttatttacgtgcatgatggacacgaggatggtgtcgtcacgcatcgctgcttcaagttctttcaggtcgataatgccgttacgctgcggtgccaggtaggtgacttcaaaaccttcgcgctccagctgacggcaggtatccagtaccgctttgtgttcggttttgctggtgatgatgtgcttgccttttttctgataaaagttggctgcacctttgatcgccaggttgtcagattcggttgcaccagaggtaaagacgatttcacgcggatcagcgccgaccagatcggcaatctgattacgggcgatatctaccgcttcttcagcctgccagccgaaacggtgagaacgggaggccgggttaccaaaggttccgtccatcgtcataaactgcatcattttctcggcaacacgcgggtccaccggcgtggttgcggagtagtcgagataaatcggtaatttcattgctctataaactccgtacatcactcaatgcaaggaatcaggctaccggctggatgtacgaccgtgtttacggagtatttagcactccggcctgattctgaattctttttattaagcgcgtaacttaacgtcgatcgcgtcttgtgtgcgggtgcgtggcgcgtcgtgagtatgctgacgaccagacacatccagcacttcctggttattaaccagttcgcctaaagtaatgttgttgagaaaaccggtgagacggtcgctcaaatcacgccacagcgcgtgggtcaggcatttatcgccgccctggcagccgcctttaccctgacaacgggtggcatctacagattcgtcaacggcgctaattacttcgccaacggcgatgctgctggcatctttgcctaacagataaccaccgcctggtccacgtacgctggaaaccagaccatttttacgcagacgggaaaacagttgttccagataagaaagggaaattccctgacgttcggaaatatcagccaacggtaccgggcccgcttcagagttgagcgcaacgtcaagcattgcggtcacggcatagcgccctttagatgtcagtctcatgtcttacttcacctcaaactcgcccctgcccggggttttttattgtaaaagtgggggtattgcatagcagggtcaagtctgacattcccgagtaaattggtcaactatttacttgactgatttagtcgggtatttaaccttcagtgccatttttttatcgtggcgtttgtacctgttgtcggatgcggcgtgaacgccatatccgccctggggttctgtacactgtaggcctgataagacgcattacgcgtcgcatcaggcaacggctgtcggatgcggcgtgaacgccttatccgacctacggttctgttcactgtaggcctgataagacgcattacgcgtcgcatcaggcaacggctgtcggatgcggcgtgaacgccttatccgacctacggttctgttcactgtaggcctgataagacgcattacgcgtcgcatcaggcaacggctgttattcggccttgttacctttattctgctgctcaatagaagccagaatcccgcgcaggatattcaactcctggctttccgggcgcgcacgggtaaacagacggcgcaatttattcatcacctgccccggatggttttcacggataaaaccggttgccagcagcgtttgttccagatgaccataaaaacgctccagatcatcgaccagcggatacggcgtctcttcatgctcgacctgctcgccgttttcctgagttgccagccaggccatgcgcacttcataggcaataacctgaaccgccatcgccaggttcagcgagctgtattccgggttagccgcaatcgcgacatgataatggcatttctgcaactcttcattggtcaagccgacgcgctcgcgaccaaacaccagcgccaccggggtatttgccgcttcagcgacgcttttcaggccgcattcgcgcgggtcgagcatcggccatggcagcgtgcgggaacgtgcgctggtgcccaccaccaggctacaaccggctaacgcttcgtcgagcgtatcgacgatgtgagcattaccaatcacatcgctggcccctgctgccagggcaatcgcctgggagtcgggtttcaccagtggattaaccagccacagattggttaatcccattgttttcatggcacgggcaacagaacccatattgccggtgtgtgacgtctccaccagcacaattcgaatattttgcagcattgtctttcttcatctaaagattattcacgcatcttatcataaaacgaagacagatgccgatctcgctgctatactctgcgccgttttcccgttctttaacatccagtgagagagaccgatgcatccgatgctgaacatcgccgtgcgcgcagcgcgcaaggcgggtaatttaattgccaaaaactatgaaaccccggacgctgtagaagcgagccagaaaggcagtaacgatttcgtgaccaacgtagataaagctgccgaagcggtgattatcgacacgattcgtaaatcttacccacagcacaccatcatcaccgaagaaagcggtgaacttgaaggtactgatcaggatgttcaatgggttatcgatccactggatggcactaccaactttatcaaacgtctgccgcacttcgcggtatctatcgctgttcgtatcaaaggccgcaccgaagttgctgtggtatacgatcctatgcgtaacgaactgttcaccgccactcgcggtcagggcgcacagctgaacggctaccgactgcgcggcagcaccgctcgcgatctcgacggtactattctggcgaccggcttcccgttcaaagcaaaacagtacgccactacctacatcaacatcgtcggcaaactgttcaacgaatgtgcagacttccgtcgtaccggttctgcggcgctggatctggcttacgtcgctgcgggtcgtgttgacggtttctttgaaatcggtctgcgcccgtgggacttcgccgcaggcgagctgctggttcgtgaagcgggcggcatcgtcagcgacttcaccggtggtcataactacatgctgaccggtaacatcgttgctggtaacccgcgcgttgttaaagccatgctggcgaacatgcgtgacgagttaagcgacgctctgaagcgttaatgactcaggcgggtgatatcactcacccgccctcgcctttcaggcgctattccgaaatacttcctcactgctttactttctttcgtcactctcccaccatctttccccgattaatggatgataaagaagtcgcaaggaaaggttatggcactgccagtgaacaaacgcgttcccaaaattctgtttattctctttgttgttgccttctgcgtttatttagtgccgcgcgttgccatcaacttcttctattatcccgacgataaaatttacggtcccgatccctggtcggcggaatccgtcgaatttacggctaaggacggtactcgtctgcaaggctggtttatcccttcttcgacgggccctgctgacaacgccatcgcaaccatcattcatgctcacggcaatgccggaaatatgtccgcccactggccgctggtcagttggttacccgagcgtaatttcaacgtttttatgtttgattatcgcgggtttggtaaatcaaaaggcacgccgtcccaggccggattgctggacgatacgcaaagtgccatcaatgtggtgcgccatcgcagtgatgtaaacccacaacgtctggtgctgttcgggcagagtattggcggggcgaatattctggatgttattggtcggggtgatcgtgaaggcatacgtgcggtgatcctcgactccacatttgcctcttatgcaaccatcgccaaccaaatgatccccggcagtggctacttacttgatgagagttacagcggcgaaaattatatcgccagcgtcagcccgatcccgcttttactcattcacggtaaagctgatcacgttatcccatggcagcacagcgaaaagttgtatagcctggcaaaagagccaaaacggttgatcctaatcccggatggcgaacacattgatgctttttccgatcgtcacggcgatgtttatcgcgaacagatggtggactttatccttagcgcgttgaatccgcagaactaacccatgatcgctagcacgataatcattcacaaaaccaccttaagacatgctaatccactggtcagaacagtttaagatgagaaaaattctgtgacgcttgccaacatttctgatgattagcattcccttcgccatttccttgagcaaactttagctattcttatcaattatgcttatgggagatctacagatgatgcctacgcttgctccaccatctgtcctttcggctccccagcgccgctgccagatcttgctgacgctctttcagccggggttgaccgccaccatggcaaccttcagcgagcttaatggtgtggatgatgatattgccagtcttgatatcagcgaaacaggacgggagatcctgcgctatcatcaactcacactgacgactggttatgacggtagctaccgggttgaaggtacagtgcttaaccaacgtttgtgtttatttcactggctacgacgtggtttccgtctgtgtccgtcatttattaccagccaattcacccccgccctgaagagtgaactgaagcggcgcggaattgcgcgtaacttttacgacgataccaatctacaagcgttagtgaatctctgctcccgacggctgcaaaaacgctttgaatcgcgcgatattcatttcctgtgtctgtatctgcaatattgtttgctgcagcaccacgctggaattacgcctcagtttaatccgctccaacgtcgctgggcggaatcctgccttgaatttcaggtagcgcaggaaattggacgccactggcagcgtcgggcgctccagcctgtaccacctgatgagccactgtttatggcactacttttttccatgttgcgggttcccgatccattgcgggatgcgcatcagcgggacagacaattgcgtcagtctatcaaacgtctggtaaaccattttcgtgagctgggaaatgttcgtttttatgatgaacaggggttatgtgatcagctttatacccacctcgcccaggcgttaaatcgcagtttgtttgccatcggtattgataataccctgccggaagagttcgccagactgtacccacgcctggtgcgcaccacccgcgcggcgctggccggatttgaaagtgaatacggcgtccatctttctgatgaggaaagtggtctggtcgcggtgattttcggtgcctggctaatgcaggaaaacgatctgcatgaaaaacagattattcttcttaccgggaatgatagcgagcgagaagcgcagattgagcagcagttacgcgaactaacgttactgccgctcaacattaagcatatgtcggtaaaggcatttttgcagacaggcgctccgcgtggcgcggcactgattattgcgccttataccatgccattaccgctcttttcaccaccgctgatctatacggacctgacgctgacaacacatcaacaggagcagatccgcaaaatgctcgaatcagcatgagggaacaactttcgggcgcaaaaacattgccggaagcgccaccagcgccattacccagaacacgccgtggcccagatattgatacaggaaaccggcgaaaacggtcatgatagcgatactgccgcccatcgcgacggcagagtaaaccgcctgtaaacggatgacttcgctaccctggcgagcagcaatataacgcatggcggccaggtggcagaccgtgaaggtgccgcaatgcagaatttgcaccactatcaaccacggcaacgccgtagttgctcccataatgccccagcgcactacgccgcaaatcgccgagatcaacagcatatcgcgtgcactacaacggcggaaaagtttattactcagcgcaaagataatgacttccgccaccacgcccagcgaccacaaataccccaccgccgaggccgagtagccagctgcctgccagtaaatggcgctaaaaccgtaataggccgcatgtgccccctgcaataaacaaacgcaggccagaaagcgccagttctggcgaaccagcgccaaccacgcagaccaaccggtgctctcctgctggcgacttgccccttgtggctgaatcgtcggacggatgagaaagccgagcagcatggatgccacgcccaacgtcaacagcgcgaggatcacccgataatcaaacatagtgaccagtttgcccgtcagcgccgagccaatgacaaacgccaccgagccccacagtcgcactttgccgtaatcaagcgggaactgcttttgccacgtattcgccagtgcatcggtcaacggtaccagtggtgagaaaaagaggttaaagccaatcatcaccagcatcagccacgctacgtgcgcccccgcccagaaggcgacagcaaagagaagtgtcagcagtgccagcacgcgcaaggcggaaatcaggcgggaaggatcgctgacgcggggcgcgatgagcaaactcccgaggaaacgggcaaccagacctgcccccaataacaggccgatggtttctggcgttaaaccaatccctttaagccagacgctccagaaaggtagaaaaatgccgtaactaaaaaagtatgtgaaatagccgagcgccaaccagcgcgtggattgcaaaaccatgagtccctcccgtcaggaggcgttagtctggggttaatcgaatgttggtgcaagttgaaaaataagaatattcgagcctgcttcccgatgtctgtaacgccagttcacaagcactaaaaaactgagatccgcgacgcatgttgcaaaaataatgcgtaattatgccgttacgcttgccaaacgttcctgcacaatggcgatgaaatcgcgtaatgccggcttcatctcccctttcttccacgccatcagtaaagcaatggaaggcacatttccggcaatgggacgaaaaacaacctgtccggtattaaaattattcatataaccgggtatcaaagtgacgcccagccccatgcccaccagattcatggtcaccagaatattcgttgccacctggacgatatttggctggctgttttcttgcgcaaaccacgctttaacgatcggcgcaagcgaaccggaatacaccggatcggtactgacgaaattcacgccatccagttgcgcggcggtgatctctttttcatgtgctaaagggtgatcaaccggtaacacaaccactaatggttcgtcaaaaagctccagataatcaatctccgggctataaacaggatggcgcattaagccgacgtcgagttcaccacggcgaattttttcctcctgttgcgtggtgattaaactcaccagctcaatcaaggtgtctggctgtctgagacgaaacatcggtaatacttttggcagtaaattcacttccgccgatggcacaaagccaatggttaattgtctgtcttcctgaacaattttccgcgcccgtaatttggcattttccgcttgttcgaggattgccagcgcgtcctggagaaaacattctcccgccgccgtcaacgcgactttgcgcttatccctcaccagtaacggaacaccgacacagttttcaagatcgcggatctggctgcttaacgaaggctgtgaggtatgcagtttttccgccgcacgggtaaagttcagtgcctgcgccactgcgacgaaatagcgtaaatgccgtagttccatcaccttccccttgttatcgaaaaaacgtctcagctggtagaaattaactatttcacatattagcaaccaaccagcaacatccttatggcacaaaaatagaaggtcaatacatcttatctttcaggattaaaaaatatgaccacaccctcagatttgaacatttaccaactgattgacacccaaaatggtcgggtcactccgcgtatttataccgacccggatatttaccaactggagcttgagcgtattttcggtcgttgctggctatttctcgcccacgaaagccagatcccaaaacccggtgatttctttaacacctacatgggagaagatgcggttgtcgtagtgcgtcagaaagacggcagcatcaaggcgtttctcaaccaatgccgccaccgggccatgcgtgtgagttatgcagattgcggcaacactcgcgcctttacctgcccgtatcacggctggtcttatggcattaacggcgagttgatcgatgtaccgctggaacctcgcgcctacccacaagggttgtgtaaatcccactggggactaaacgaagttccttgtgtggagagttataaagggctaatttttggcaactgggataccagcgcaccgggcctgcgtgattacctgggtgacattgcctggtatctggatggcatgctggatcgtcgcgaaggcggcaccgaaattgtcggcggcgtacaaaagtgggtgatcaactgtaactggaaattcccggcagagcagttcgccagtgaccagtatcatgctctgttcagccatgcttctgccgttcaggtattaggggcgaaagatgatggcagcgataagcgcctcggtgatggacaaaccgcccgcccggtgtgggaaaccgccaaagatgcgctgcaatttggtcaggacggtcacggtagcggtttcttctttactgaaaaaccggatgctaatgtctgggtcgatggcgcagtttcaagctattaccgcgaaacctatgccgaagcagaacaacgtttaggtgaagttcgcgccctgcgcctggcgggtcataacaatattttccccacgctttcatggctaaacggcactgccacactccgcgtctggcatccgcgcggccctgatcaagttgaagtgtgggcgttctgtattactgacaaagccgcctccgatgaagttaaagccgcttttgaaaacagcgccactcgtgcttttggtcctgctggttttctcgagcaggatgactcggagaactggtgtgaaatccagaaattgcttaaaggccaccgcgcccgcaacagcaaactgtgtctggaaatggggcttggtcaggaaaagcgccgcgacgacggcattcctggcattactaactatatcttttcagaaactgccgctcgtggaatgtaccaacgctgggccgatcttctgagtagcgaaagctggcaggaagtgctcgataaaaccgccgcttaccagcaggaggtgatgaaatgagtgcgcaagtttcactagagttacatcaccgcattagccagtttctctttcacgaagccagcttactggacgactggaaatttcgtgactggctggcgcagctcgacgaagagattcgttacaccatgcgcaccacagttaacgcgcaaacacgcgaccgccgcaaaggcgtccagccaccgacaacctggatttttaatgacaccaaagaccagctggagcggcgaatcgcccgtctggaaacgggcatggcctgggcagaagagccgccgtcacgcacccgtcacttaatcagcaactgccagataagcgaaaccgacatcccaaacgtatttgctgtgcgggtaaattatctgctttatcgggcacaaaaagagcgcgatgaaacattctatgttggaacgcgtttcgacaaagttcgccgtctggaagatgacaactggcgcttgctggaacgggatatcgtcctggatcaagcggtaatcacttcccataacctgagtgtactgttctgatgaatcgaatttatgcgtgtcccgttgcggatgtgccggagggtgaggctctccggatcgatacctcgcccgtcatcgccctgttcaacgttggcggcgagttttatgccattaacgatcgttgcagccatggtaatgcgtcaatgtcagaagggtatctggaagatgacgccacggtggagtgcccgctacacgccgccagtttttgcctgaaaacggggaaagcgttatgcctgcccgccaccgatccgctcaccacttatccagtacacgttgaaggtggtgacattttcatcgacttaccggaggcgcagccatgagcgatctgcataacgagtccatttttattaccggcggcggatcgggattagggctggcgctggtcgagcgatttatcgaagaaggcgcgcaggttgccacgctggaactgtcggcggcaaaagtcgccagtctgcgtcagcgatttggcgaacatattctggcggtggaaggtaacgtgacctgttatgccgattatcaacgcgcggtcgatcagatcctgactcgttccggcaagctggattgttttatcggcaatgcaggcatctgggatcacaatgcctcactggttaatactcccgcagagacgctcgaaaccggcttccacgagctgtttaacgtcaatgttctcggttacctgctgggcgcaaaagcctgcgctccggcgttaatcgccagtgaaggcagcatgattttcacactgtcaaatgccgcctggtatcctggcggcggtggcccgctgtacaccgccagtaaacatgccgcaaccggacttattcgccaactggcttatgaactggcaccgaaagtgcgggtgaatggcgtcggcccgtgtggtatggccagcgacctgcgcggcccacaggcgctcgggcaaagtgaaacctcgataatgcagtctctgacgccggagaaaattgccgccattttaccgctgcaatttttcccgcaaccggcggattttacggggccgtatgtgatgttgacatcgcggcgcaataatcgcgcattaagcggtgtgatgatcaacgctgatgcgggtttagcgattcgcggcattcgccacgtagcggctgggctggatctttaaggaagcacgatgaaagaaaaaacgatcattattgtcggtggcgggcaagcggcggcaatggctgcggcctcgctacgccagcaagggttcaccggtgagctgcatctgttttccgatgagcgacatcttccttatgaacgacctccactctcgaaatccatgttgctggaagattccccgcagttacagcaggtgttacccgctaactggtggcaggaaaacaatgttcatctgcattccggtgtaaccatcaaaacgctgggtcgcgacacacgagagttagtgttaaccaacggcgaaagctggcactgggatcagctttttatagcaaccggcgcggcagctcgaccgctgccgttgcttgatgcactgggagaacgctgctttaccctacgccatgccggtgatgccgccagactgcgagaagttctgcagcccgaacggtcagtcgtgattatcggtgccggaactattggtctggaactggctgccagcgccacgcagcgcagatgtaaggtgacagtgattgaactggcggcaaccgtcatgggccgtaatgcaccaccgcccgtgcaacgctatcttttacagcgccaccagcaggctggtgtgcgcattctgctcaataatgccattgaacatgtggtcgatggtgaaaaagtagaactgacgctgcaaagtggggaaacgcttcaggctgatgtggtgatttacggtattggtatcagcgccaacgagcaactggctcgcgaggccaaccttgatactgccaatggcattgtcattgatgaggcttgccgcacctgcgatcccgcgatctttgccggtggcgatgtggcaatcactcgtcttgataatggtgcactacaccgctgcgaaagctgggaaaacgccaataaccaggcgcaaattgccgctgccgcaatgttagggctaccgctaccgctactgccgccgccgtggttctggagcgatcagtacagtgataacttacagtttattggcgatatgcgtggcgatgactggctttgtcgtggcaacccggaaactcagaaggcgatttggtttaatctgcaaaacggcgtgcttatcggtgcggtcacgctgaatcaggggcgtgagattcgcccaattcgcaaatggatccagagcggcaaaacgtttgatgcgaaactgctgatagatgagaacatcgcgcttaaatcactgtaaccaggataattagcgaatatctcaatgcctggggcgtggcgaggtgcaagagtgtgtattacgtttaaatcacattatcttgcaaagggattggttatgaacacactacgttattttgattttggagctgcccgccccgttttgttattaattgcccgtatcgccgtggtcttaattttcattatttttggttttcccaaaatgatgggctttgacggtacggtccaatatatggcctcgttgggcgcgccaatgccgatgctggcagcgattattgcggtagttatggaagtgcccgccgcgatattaatcgtgcttggctttttcacccgtccgctggcggtgctgtttattttctacacgctgggtacggcggtgattggtcaccattactgggatatgaccggcgatgcggttgggccaaatatgattaatttctggaagaatgtcagtatcgctggcgcgttcttgctattggcaattaccgggccgggggcaatttctctcgatcggcgttaggaaagatgccggatgcggcgtgaacgccttatccggcatttaataaattacagccactctacccgcaacgacatctctgaagttgttgattcccctggtgctagcgcaatgagatcacccccttccgggcgatgatgatcatccggcgcatggctcatcggttccagacagaagaaatcaaacgcatatcctttatcaaacgcagggtcggaaacaaagatgaaataacacggtgcaggtggcgtcgtttccatgatgatggcataaccttcctgcggctgctcgatgcgggcctgaccattccatccggcaaaaccattgttcacccactggcgcggcaacggcgcgggctggttaaaatccagttcctgcggtagctgctcgcaaaactcacccgccagccactgctcccgctccagccagtaaccgctcgcctgtgcctgaatccgcgtttgcggcgacaacggaaaataaggatgccagccggtaccaaatggcagcgtctctgccccttgattggtgacagagagcgtcaccgtcagcgtatccgccgttaaatgaaacgcctgacttacccgatagtgatagacaccgctgcgatgttcatacaccagacacaaactatcatcgctgtgcgagacacattgccactcgcccagccagccatcgccgtgtagatagtgcgcatcccactcaacattcggttgcagttgatactcacgcccctgccagacaaaacgattgccgctcacccggtttgcaaatggcaccagcggaaaacatgaggcatcggttgccacaccgctttttttaccaggacgtaagagcggcgtcgtatcgcgccagaagccttcgattacgccgccctggtcagaaacgtccagctttagcgacccgtgggataaggtatagatggtcatccgctaactccttaatccgggaagttaatcacaactttcccgcatttgccgctcgccatcagcgcataggcatcacctgcctgttccagcgagaagcgatgggtaatggcgttacgcggccacagcttccagtccgtcagatcatgggcgcatttttccatatggaacagactggtcacccaggagccgataatccgccgttgatggtgcatcagatcggcgctgacctcgaattccacttttccggtttcaccaatgtaaaccacccgtccccagtcagcggtggattgcagtgccagcaagcgacctgcggcattaccggaacaatcgagcgcaacatccgcgccaccgtgggtgagttcggcgataatctgcggcagaccttcggtggttgctaaatagccgtgatccatcacccctaactgttttgccatcgccagacgttccggcagcatatcaacgccgatgatccgttttgcaccgcgacctttcgccagcatcatcgccatcatgccgactggccccagaccgaccaccagcacgttatcactgccggaaacttcgccgcgcaaaattccttcatacgctgtaccaacgccgcaactgataaacgcaccatcttcgtagctcagcgcatccggcaggaggatcagatctttttcttccgccagcaagtattcggcatgaccgccgtcacgctgccagccgtaagccgcttttccttcgccagtacaagaaataggaaaaccgcgacggcagttcgggcaaaaaccacagccagaaatgtgatacaccagcacgcggtcgccctctttaaaatggcggcagccttgccccatcgccacaatctgcccgcacggttcatgaccgttgataaagccctggtataacggtttatcgggtgccgccgctgtggcacggtgttgatgatagatatagtggacatcgcttccgcaaatcccggaggatttcattttgatcagtacctggttaatccccggcgtcggcaccgcaacttcccgcagatcgacggtcgaatttcctggtaaataagctgccagcatcgttttcataaatccctcattaacaatacgattaattttcatccctgccgcacccgcgccaggggcgttaaggtttagcgtttcgctttactgcttcgctgggtcagcaagatattcgccagcaccgccaccacgatgatgacgccgcgtaccacctgctggaaaaaggagttaataccgagcagcaccagaccgttaccgattagcgtaatcaccagcacaccaagcaatgtaccgaacagggaaccgcgaccgccggaaagtgccgtaccgccgaccacgaccgcggcgatgacgtcaaactccagaccgtttgcggcacctgcgttaccagaaccgaggcgcgccgccaacaaaatgccggtcaccgccgctaataatcccgaaagggtaaagataagaatgcgcacccgacgaacgttgatgccgcacaactgcgccgccgtagcattaccgccaacggcaaaaaccgagcgcccgaaggcggttttgcggctgatgaacacaaacagcgcaaacaacacaatcatgatcagcgcggataccggcacaccgagaaattgtccgcccagccagtccagcacctcgttttcatcaatcggcactggcagtgcgttcgtcataaacagccccattccgcgcagggcgctccacagccccagtgtggcaacgaaacttggtacattaaacacgccgcgcagcaccccggccagcgttcccatcagcgcgcctaacagcaacaccagcaggcacgccaccgccagcggaacttcaaattgcagcaaaaatgccaggcacaccgagacaaaagccaccatcggcccaacgctgacatcaatttcaccggagataataatcagcgtcatcgcccaggcggcaatcccaatggtggcggcatcgcgcagcacgttcatctggttattcaatgagataaagccaggcgcgttcagggagaagaccagataaagaatggcaatcaccaccagcaaaccgatctcattaatatggcgactgacaaattgtttgagcgagacgctcttgccctgcggcaatggtaatgacgaagcagacatcttcaggttcctcggtaaaattcatcagtgcacagacagaatggcggacatcagctcatccacattgaccggagcgtgaaactcctgcgagaacgtgccgtgctgtaataacaggatgcggtcacacaccagcggcaactcctccacttcactggagataaacaccacgctttttccttcggcagccagctcacggacaatacggtaaatctgctgtttggcttcgatatcgacgccgcgcgttggctcgtcgagcaacaaaatctggctggcagcatagacccaacgaccgatcaccactttttgctgattgccaccagaaagcgtgccgatgggtgtttcgctactggcggccttgaccgtcatccgctgcatcacctcttcggtcaggcggcggatggtggaccattgcagcacaccgttggcgctgattttttgccgattggtcagcactgtattttcgtcaacgcccaaccagggaatgatccccgcttctttgcggttttctggcgtatagccaatgccgcgtttcagcatgtcgccgtaatcggggcgcgtgattttctcgccgttgataacaatttcgccctgttcatactcctccagcccaacaatcgccttcagcaattcactgcgccctgcccccagcagaccagcaatgccgagcacttcgccacgacgtagcgtaaaactgatatcctccagcttgggcttatggcgtaacgcacggacttccagcacggcctgatccacaatttcctgaggggctaccggcgcaatatcaacgtgatcgcgcccgagcatcagcgacacaatatgatgcgtggaggtgttttcgagcatcacatcgcccgccacctgaccatcgcgcataacggtggcacaggaggcaatgcggcgaatttcttccatccggtggctgacataaatcaccgccacgcccagtgccgacatctttttcaccgcgctgatcaccagttcaacttccgcactcgcaagcgaactggtaggttcatcaagaatgaccacgcgcggctcgcccttcatcacccgcgcaatttccaccagctgcttttgcgccgggcttagcgttgaaacaagttgttcaggactaacgtcaacgcccagcgcctgtaagcaacgttgggcatcctgcgccatttgcaggtaatcaatcatgccgttgcggcggggccactgaccgaggcagaggttttccgccactgtcagcccttccaccagacttaactcctgataaaccgcgcgcacccccagttcagcggcacggcgagtcagcgtagcttcgtcaccttccagtcgcgtctcgccaatccagatatcaccgctatccgggcgttcgctgccggtaagcattcgaatgagagtcgatttgcccgcgccgtttttacctaacagcgcacgaacttcgcctttattgagcgtgaagttaacgttatccagcgcaacgacgccgggataacgcttatttcctgccaccacttttgctaccgggactgcctctgttgccgtgaacatagggacctctgcgaatcagcgattagggcagaccatcaacgtgcgttgccagccactgtttaccgtcttccgttttggtatagagatcgataggcacctgaatcactttttcaccgtcggcttgtttattgataaccttcaatgtttgcgcgaaaacagcattgcccattttcttaccggaaatatccactaccgctttcagcacctgattgttttccagctcctgagcaatttcggttgtcatatccgaaccgaaaacagcaatttttccggcctgattttgattacgtaccgcttttaccgcgccgagtgtcgcaccgcccgattcccccataatggcgttgagatccggcgtggagataattagtttttcaccaacggaaatcgctttatctaaaacagtcccttcctgattagcgacaatttgcgcgccgggaacgcgggattttaaaacttcttcaaatcctttacgtcgctgcacacaaacttcaaaggcttcgcaattgatgacggcaattttcggctggtcaattttattggcaataaaataatcagcggcagcgttacccagttttttaccaaattccagcggatcgccgaccagatacgccgagacatatttatcgacccccttttgattaatacaggtgttgtagcaaatcaccggaatgcccgcttcactggcgcgacgaacggtacggctactgccattttcagacactgccgataaaataatggcatcgacattacgcgccacgagggtatcaacaaaggtactttctttcgaaatatcaccctgggcgttagtttctattaactgaacttgtactgaggaatcttttgccgcatcctgaacgccctgacgcactccagcgtagtatccctgagtatcaaggtatattgcgccaatggtcatttctttttccgcagccctggcaaatagtgcgctacctaatagcgtagccattaataatagattacgggttgttctcatttttgtaggcatagagcctcctgtagggtttttattaacaacggcttattctaattattttgtgatgagcggcagcgcgtgccgctcaaatattacagttaatagggtttagtgaacgcggttaaaaataaaaggcatcacggtggtgaataatgccgctttcggccaagccggattaatcgccgtcaattcagcgcgagcagactcatattgcgcaacctccccgagtcccgcggacgccagcatcgccaccatcaggcatttttctttatgctgctgttgtaaatcgccatacagcgacaacaagtcaggttgcgagacggcaaagaaatccgcttcgatactggttttcgccatctcttgcgcccactgtttcatttcactaaacagttgctgtgcggtttgttgttcgcccagcagtcgcagcgccatcccttgccagaagagataatcaaccggctgatcgttgtaataactgtgaatgttaatagtgcgatcgccggtcgccgccagacgtaaacaacgcgtcgcttcagtttcatcgccctgcgcgttggcgcatatcgcctgccagaaccagatgtcgttatcagtttgccccggtaaacggccttcgcttaaattctccggataatgcagcgcggcatgaagcagttcgcaggcctgctgcggctgtctggcatcaagatgctgccaggcgcgtaataactggttgaggataaactgactggtgaccttcccttccccgccttcccacgggtggaatttgcgcgtggcgagaatgtccgccgctttgtctgcctgacccgtgagatgccacaaattgagcagttctgcggtcatgtcgtcgcgtttcagcgcaatttccagattattttccagacgcgccagtcgtttctccggtgtggctccacttaacttatccagcaaatcccgttcgaaaagcagacgtgcatcctgcggcgcaagctgataagcattatcaagataacgcgcggccagctcataatcgtgttgcttattccacgcatggatcgctaacccgcgccagccgtcggcaaactccggcgacatctctacgcaacgttgccaaaaggcaatggctttgttgtagctacgtttgttgtagtagaagcaagctagtaaatggcgagcaaaccagcactcttcaatactctccagcgccgccacttcttccagcgtattcgggaaacggacaaactgcgggaagacatcaatggcttttgcgaccagttcgccacgttcggctttcggcagcaagctggcttgcaggtaaagcggcagcgtgcgctggcagtccagtgcgttcagcatctctgccgccagggtgggcattccccagttaatcagttgcccggcggtcatcagggcgttaacgtcgcgtccctgacacagaccgcgccactgcgcgagagctgattcgctacgaccatcgaaccagttcagccaccacagagtggcgttcagcggataatcgcgcagcagtttctcgcgctgcacacgcgcgttgtcctgacgaccacttaacaccagcagcagattatgcaggcaaagcacttcctgattggttgggcaggcgcgaagactttgttggcaaaaatccagaccagcgtcgaagttaccattacgcgccgccagtcgtgccaggccataatagccaccggctttgctgttgccgctccagaccgcacgccagaaatcctcttcggcttgttgatattgtccctgacgttcgtaagcactggcgcgaatcaaactcgcctgtccgcactgcggatttttgttcagcgcatgtgcgcgtttcagagcctgagtggcatacgccaccgcttgcgggaaatctgcgcggttatattccagcatcgccagcgccaggttacagcgataatccagcgggtccagcgccacgccgcgcaggtagtaatcgaacggtgaacggctggcgtgatgatattgctccagatgctgaccgataaaccaggcttcatctgtactggtaatgtcttgtgctgccagtggcgctttggcgacgtccggtaacggcaacgcttgcggctgatgttcctgataactcagtacaatattgccgtcggcatcggagagctcaatggtcagcctttcaggattgataccgtgcaacacgccctggatggcggtcgcaggcatcagtgccacggcatcatcaagtaacgcgttgcatttaccgatttcgcggatcgccaggcggtatccgttcaacggagagatggcatacagcccccactcaatcccccgcttactacgctggagttttatcaccgcatcgcgggaggcattttgcaccatgcccaaagaatgataaggcaggaaatactgctcaaaacgcttctcttcgtaagcatcaagccaggtaaaatcgggctggttatcggcaaaaataccggtcatcagttcgatatacgggccgttattgtcggtcagactcttatcccacgcctggccaaattcactgtgtccccaactccactgttttttacctggcgcaatatggtggttggcaacgtgcagcaaaccgccatcttcatcgtgacaccacgcgccgacaaaatcgtactgcgatttttcggccatatatgaggttggaacaggcacatttttatagcgagaaatgtccactccagcggagtagtccactttgtagtaagtgccggtagcgatggggaaagcggagacggcccgtttgccgtgatcaaacaccgccgttacatccggcgggaagacgctctgatgcccttccccccctttcactgccgggttggcccaccacaagaaatgacgcggcgtggcgttcccgttatagacgcggctggcgatttccagcgccgcccggtcagggcgcagggtgaaacctgtcatcacctgtaaaccatgcatcggctccgtttcgcctacccacaccgtctgtgcaccgtcttcatgggcttcgagggtgaaatcaacgggcataaaggtggtcgggcgatgatgttgcggccagttaaactcaatcccaccggaaatccacggccccagcagccccaccagcgcaggtttaatgacttcattgtgataaacaaaatcgcgctgtttcactttatcccacgcgcgatgcacccgaccgcccagttccggcaggatcatcactttgatgtagtcgttttccagccacaccgcctgccaggatttcagggttttctgctcgctcagcgtatcggtcacgccgtagggataaaccgcgccggacgatccctgataaacgcgattttccaggaacatgggatgtatatcctgcggcccggtttcataggtcgggatctcaacgcgctcttgccacacttttactggagtcatggtgccctcaatattaacaagacatactgaattaaaagatttgtggcagtgtattgaacaatctggcaatgttttcgcggaataatcacgcaattaactaaacaaggtttagtgaagatgagagcctgcattaataatcaacagattcgccaccataacaaatgcgtgattctggaactgctgtaccggcaaaagcgcgccaataaatcaacgctggcccggctggcgcaaatttcgattccggcagtcagtaatattttgcaggaactggaaagcgaaaaacgggtggtgaatattgacgatgaaagccagacgcgcgggcatagtagcggtacatggctgattgcgccggaaggtgactggacgctgtgcctgaacgtgacgcccaccagtattgagtgtcaggttgctaatgcttgtttaagtccgaaaggtgaatttgagtatttacagattgatgcaccgacgccgcaggcgctgctgtccgaaatcgaaaaatgctggcatcgccaccgtaaattgtggccggaccataccatcaacctggcgttggcaatccacggtcaggttgatcctgtgaccggcgtgtcgcaaaccatgccgcaagcgccgtggacaacgccggtggaggtgaaatatctgctggaagagaagctcggcattcgggtgatggtcgataatgactgcgtgatgctggcgctggcggagaaatggcaaaataattcgcaggaacgggatttctgcgtgatcaacgttgattacggcattggctcgtcgttcgtgattaacgagcaaatttatcgcggcagtttgtatggtagcggacagattggtcacaccatcgttaatccggatggcgtcgtctgcgactgtggacgttatggctgcctggaaactgtcgcctcgttaagcgcattaaaaaaacaggcgcgggtatggctaaaatcacaaccggttagtactcaacttgatcctgaaaaactgactacagcgcagttaatcgctgcctggcaaagtggagaaccgtggatcaccagctgggttgatcgctctgccaatgccattggtttgagtctgtataacttcctcaacatcctcaatattaatcagatttggttgtacggtcgcagttgtgcctttggtgagaactggcttaatactattattcgccagacaggatttaacccgttcgaccgcgacgaaggaccgagcgtgaaagcgacgcaaattggctttgggcaattaagccgcgcacaacaggtgctgggaattggctatttgtatgttgaggcgcagttacgacagatttgatggcgcgataacgtagaaaggcttcccgaaggaagccttgatgatcataaacgaaaaattgcctgatgcgctacgcttatcaggcctacacggagattgcaatatattgaatttgcaaagttttgtaggccggataaggcgttcacgccgcatccggcatgaacaacgagcacattgacagcaaatcaccgtttcgcttatgcgtaaaccgggtaacgtgcgcagatgtcgagaactttacctttgatgcgctcgataacggcttcatcattgatgctgtccagcacgtcacacatccagccagccagttctttcgcttcggcttctttaaagccgcgacgggtaatcgccggagtacctacacgaataccggaggtcacaaacgggctcttcggatcgttcggtacgctgtttttgttgacggtgatgttagcacggcccagagcggcgtctgcttctttaccggtcaggtttttatcaaccagatcaaccaggaacaggtggttatcagtgccgccggaaaccactttgtagccgcgctcgaggaacacttctaccatcgctttagcgtttttagcgacctgctgctggtaagttttgaactcaggctccatcgcttctttcagagcaaccgctttaccggcgattacgtgcatcaacggaccgccctgaccaccagggaaaacggcagagttcagttttttgtacagctcttcgctaccacctttcgccaggatcaggccgccgcgcggacccgccagggttttgtgagtggtggtagtaacaacgtgagcatgaggaaccgggttcgggtagacgccagcagcaaccaggcccgcaacgtgcgccatatcaacgaacaggtaagcaccgatgctgtcagcgatttcacgcattttcgcccagtccaccacgccggaatatgcagagaaaccaccgataatcattttcggcttgtgttctttggcttgtttttccagatcggcgtagtcgatatgaccggtagcatcgataccgtaaggaacgatgttgtacagtttaccggagaagttaaccggagaaccgtgagtcaggtgaccgccatgcgccaggttcatacccagaacggtatcacctggttccagcagcgcggtgtagaccgcaaagttagcctgggagccggagtgcggctggacgttagcgtagtcagcgccgaacagttctttcgcacgatcgatcgccagttgttcaacgatatcaacatactcgcaaccgccgtagtagcgtttgcccggataaccttcagcatatttgttggtcagctgagaaccctgcgcctgcattacgcgcgggctggtgtagttttcggaggcgatcagttcgatgtgctcttcctgacgtactttttcctgctccatagcctgccacagttcggcatcataatcggcaatgttcatttcacgctttaacatccgcatctcctgactcagctaacaataaaatttttggcctttataggcggtcctgttggacaacggcgaacagtataaccgaatcattgtgcgataacaggtcttgacaaaggaatttacgcaaacgattaccttcaggctacgcaaggctttggagaataaagagcttgcaaccggaaacggatttcttttcaggtttgtgatgcaaatttttcacttcatcacattctttctgaaaaacaccaaagaaccatttacattgcagggctattttttataagatgcatttgagatacatcaattaagatgcaaaaaaaggaagaccatatgcttgacgctcaaaccatcgctacagtaaaagccaccatccctttactggtggaaacggggccaaagttaaccgcccatttctacgaccgtatgtttactcataacccagaactcaaagaaatttttaacatgagtaaccagcgtaatggcgatcaacgtgaagccctgtttaacgctattgccgcctacgccagtaatattgaaaacctgcctgcgctgctgccagcggtagaaaaaatcgcgcagaagcacaccagcttccagatcaaaccggaacagtacaacatcgtcggtgaacacctgttggcaacgctggacgaaatgttcagcccggggcaggaagtgctggacgcgtggggtaaagcctatggtgtactggctaatgtatttatcaatcgcgaggcggaaatctataacgaaaacgccagcaaagccggtggttgggaaggtactcgcgatttccgcattgtggctaaaacaccgcgcagcgcgcttatcaccagcttcgaactggagccggtcgacggtggcgcagtggcagaataccgtccggggcaatatctcggcgtctggctgaagccggaaggtttcccacatcaggaaattcgtcagtactctttgactcgcaaaccggatggcaaaggctatcgtattgcggtgaaacgcgaagagggtgggcaggtatccaactggttgcacaatcacgccaatgttggcgatgtcgtgaaactggtcgctccggcaggtgatttctttatggctgtcgcagatgacacaccagtgacgttaatctctgccggtgttggtcaaacgccaatgctggcaatgctcgacacgctggcaaaagcaggccacacagcacaagtgaactggttccatgcggcagaaaatggcgatgttcacgcctttgccgatgaagttaaggaactggggcagtcactgccgcgctttaccgcgcacacctggtatcgtcagccgagcgaagccgatcgcgctaaaggtcagtttgatagcgaaggtctgatggatttgagcaaactggaaggtgcgttcagcgatccgacaatgcagttctatctctgcggcccggttggcttcatgcagtttaccgcgaaacagttagtggatctgggcgtgaagcaggaaaacattcattacgaatgctttggcccgcataaggtgctgtaatttgatgttgccggatggaaacatccggcaacccttgacgcggtttaaattgccgcgtcgtcctcttcaccggtacggatgcgaatgacccgtgccacgtcaaagacgaagattttaccgtcaccgattttgccggtttgcgccgtgcgaataatggtatcgacacaggtatcgacaatgtcgtccggtacgacaatctcaattttcactttcggcagaaaatccaccatatactccgcgccgcggtacagctcggtatggcctttctggcgaccaaagcctttcacttcggtcaccgtcatgccggtaataccgacttcggccagtgcttcgcggacatcgtccagcttgaagggttttataatcgcatcaatctttttcatgctattccttgaaaaggtcgcctgtcttttgatctgctaaacgtaacacataacgccaattcattccttgaaatcgtttgcatccagctcgtgtcgggaaagcagtttataaaattctgtccggttgcgccccgccattctcgccgcgtgggtgacgttgcctttggtgatttgcagcagcttacgcaaatagttgagttcaaactgattacgtgcctcaacaaaggttggcagcgccgtattttcaccctccagcgcctgctccaccagcgcatcactaatcaccggagatgaggtcagcgccacgcactgttcaatcacgttgaccaactggcgcacattacccggccagctcgcggtcatcaggcgtttcatcgcatcggtagagaacgcgcggacaaacggtttatgtcgctctgccgcctggcgcaacaggtgatttgccagtagcggaatgtcttctgtgcgctccgccagtgccggaattttcaggctgacaacgttgaggcggtaatagagatcttcgcggaattccccgcgcgccatcgcttttggcagatcacggtgagtggcagaaataatccgcacattgatatcaatatcgcggttactgcccagcgggcgcactttacgctcctgcaacacgcgcagcagtttgacctgtaacggcgcaggcatatcgccaatttcatcgagaaatagcgttccgccttccgccgcctggaataaaccttcgcgattgctgacagcgccagtaaacgcgccacgcgcatgaccaaacagctccgactccagcaattgctcgggcaatgcgccacagttaatagcaataaatggtttgctgttgcgcgggctggcgttgtggatagcctgggcgaaaatctctttcccggtgccgctctgaccgttaatcaaaacgctgacgtctgattgcgccaccagccgcgcctgttccagcaaacgcagcatcagcgggctgcgggtgacaattgcctcgcgccagcgttcatcggtggctggcgcggattgctccagcgcatcgtcaattgcctgatatagcgcgtctttgtcgacaggcttggtgaggaaactaaaaacgccctgctgtgttgcagcaacggcatcgggaatagaaccatgcgcggtaagaataattaccggcattcccggctgcactttctggatttcagcaaacagctgcataccgtccatttcatccatccgcaggtcgctgatgactaaatctactttttcgcgattcagtacccgtaatccttcagcgccactttccgccgtgaccacactgtagccttcgctggtcaggcgcaggccaagcagtttcagcaatcccggatcgtcatcgaccaataataaatgcgcaggtttatggctcatcaggagtgacctcatgggtggatggcgcgggcttttcactctcgtgcggcgtatccggcgagaaatttccagccggtttgcgggtcgagagctggcgttcaatatcggtcaggttttccagcttgcgggtggtgagttccagttgctgctgtagaacgtgatgttgctggcgcaatgtatccagctcgctgtcgctggactgctggagtttactgtaacgttggcgctcttccgccagttgcagttgcagcgcctgaccatcgcgccagagttgatacagtgggcgaacctgtgccgggatctcggtacttaacgcttcaatacgcgcgaccagctggcggcgctcatacggcgtaattttggcgtcggcgagcaaaatcccttgtttaaaggtattttgccagctgccgtcgtcatattggcgagcttgctgacgcgactgcgcaggcattaaacgatcagcacaatccatcgcccgcagccagtaaagcggattggtttcggttgatttaccttgcagcgcccagatgtcgctacattcagtagaaagatagtcagccagttgataaaccggaattttttcttctgctggcgtatcaatggctggcttattgtgattctgcacgcaacccagcaatgccagacatggcagccctgccagccacagccgtcggggcaataatcgttgaaaaatgtgtcgcatattcaccagacttaaagcctatcccagtgggcgtaattgttgcagacagtctggacatggacagcgcggagaaaccggagcgtacatatcgtacgtgaagatttcgagcactgcccggggccgaactgacaaataaaatagcctgataggataggctgttagcattatttcgtgtttttcgacgacggtaattcaatgcggaaacaaacgtcttgcccgctctcgtcgaccagatacagttccccttgcatacggcgaatacaatccctggcaatgcttaatcccagaccgctgcccttcaccgccccttttcgctggtggcttccctgaaaaaagggttcgaagatcatggcgcgttcctcttgcggaatgggcgtgcctgtattgatgacatcaatataaacccgcgcaccatgtaaactgctgcgaaggcaaatgttaccggattcagccccgtagtgcaccgcattggagtaaagattatccagtacgctcatcagcagcattggctccgccaggcaagctgttgctttgagatcgacgtcggtatgcatcattttagcccgtgcgggcaggctatgagcagaaaccactgtctccaccagcggtgctaactcaacattctccagttccaccgcactgtccgcctgtttacggttgtaatcaagcagttgttcgatcagtttttgcaaattgcggctgctgctatcaagaatgctcaccacctctttttgctctggcgtaagcggcccgacaacctggtcagccagtaattcagtgccctcgcgcatactcgccagtggcgtttttaattcatgagataaatgtcttaaaaattgatggcgttgggattccagccatgacaggcgctcacttaaccaaagaatacgttgcccaaccgagcgtaactcgctcggtccactgaacgagacgctattgcccagagaacgcccttcccccagacggttgatcatgcgctcgatatttttcaccggcccgataatcatccgcgtgaaaagcagtaccattaccagactcaccagaaatagcaccagcgattgccaaccaaaatattgcccacgttcggcgatttcacgctgaagctgctgcccacgagagaacaccactgtgcgcgtggcctgtaccatttcggtattggcactggcaaaggcttcaagacgtgcggcggcggcagcatcgggaccgctgttgttacactgaagttgagccagattgtgcaaatcctgacgtaatgcctggtagagtttatcgtccggcagcacgcctgcgtgggcatcgagcatttcgctgtaacgcttgcgctggctttgataaaccttcgccagggttgggtcgtccagcacgcaatactgacggtaactacgctccatctccagcgccgcgttggtcatcgcttcactgcgccgggcatcaataagcgtagtgcggttaaccagcgccgcctgatcgctaagcgcattcaggctttgccaggcttgccatgccagcaccaacaggggcagcagaatcagcaaaaatgccagcattaccagttgtcgtaatgagcggggaaaaacgggccagcgtttcaaggtgttactctcgtcagacgcgaatagcctgatgctaaccgaggggaagttcagatacaacaaagccgggaattacccggctttgttatggaataaggcggtgcctaactcgacgtttcgcccgatggttgatatagctacgctgatatcagaagttggacggcaggcaccttgttgtgcgtcattcgtattttatgtagcacgtcccgaaggggctgacataagtcggtgaatgagccactggttactattatgcagtaactgtgccaataaagaaaatagtttggtaacgtactgattatacgttgctttgaggggtttatgtctcctccgctgtttgaatgtaaatcagccactgtgtcgctaaaaagagacaacttaagataaacttattagataatattaaaatcaatgagttaagtgtcgccagaaagcgacacggcaaaccacccattgtcgtgatttacagacacaaaaaagctcccggagttgggagcttatgatagtggttggtgcttaatgccgcatccgggctgcaaaaccaatgggctgacgacttaccccaactgcttacgcgcattgcggaaaatgcgcatccatgggccatcctcgccccagttttccggatgccaggagttgctgacagtacggaaaacacgttccgggtgcggcatcataatggtgactcgaccactttcagtcgtgactgccgtaataccgttcggtgaaccgttcgggttagccgggtaggtttcagtgactttgccgaagttatcgacatagcgcagtgccaccagccctttgctttccagtgccgccagatgcgccgcatcacgcacttccacgcgcccttcaccatgagagacagcaatcggcatttgcgagcccaccatcccctgcaacagcagagacgggctttgggttacttcaaccaggctgaaacgcgcttcaaagcgatcggaggtattgcgcacaaaacgtggccacaactcactacctgggatcagttcacgcagattagacatcatctggcaaccgttacatacccccagcgccagcgtttgcggacggtggaagaaggttgcaaactcatcgcgtacacggtcattgaacaggattgacttcgcccaaccttcaccggcacccagcacatcaccgtaggagaaaccaccgcacgcgaccagggcgtggaaatcttccaggcccgtgcgtccggtcagcaggtcactcatatgcacgtcgatagcatcaaagcctgcacggtggaaagctgccgccatttcaacatgcgagttcacgccctgctcacgcagtacggcaactttcggacgtgcgccagtggcaatatacggtgctgccacatcttcgttgatatcgaacgacagttttacattcaggcccggatcggcgtcgttagatttcgcctgatgctcctgatcggcacactccgggttgtcacgcaggcgctgcatctgccaggtagtttctgcccaccagacacgcaacgtggtgcggctttcgctgaatacagtctgcccgttggcggtaatcacaaaacggtcaccggaaaccgcctgccctacataatggacacaatcagcaagcccatgctgtgccagtacggactcgaccgcttcacggtcagcggcacgaacctgaatcaccgcacccagttcttcgttaaacaacgccgccaggcgatcgtcacccagagtggcgatatccgcgtcaatgccacaatgaccagcaaaggccatttccgccagcgttaccagcaggccgccatcagagcggtcgtgatacgccagcagcttacgctgtgcaaccagcgcctgaatcgcgtcatagaagcctttcagttgcgcgacatcgcgtacatctgccggtttgtcgccaagctgacgataaacctgcgccagcgccgttgcgcccagcgcgttattgcctttgcccaaatcaatcagcagcagtgcgttatcttcggtagaaagctgcggcgtgatggtgtgacgtacatcttccacgcgggcaaatgcagaaatcaccagcgacagcggcgacgtcatttcgcgctcttcgttaccttcctgccagcgggttttcatcgacatggagtctttacccaccgggatcgtcaggcccagcgccggacaaagctcttcgcccacggctttaacggcttcatacaggcccgcatcttcaccagggtggcctgccgccgccatccagttggcggaaagtttgatgcgtttgatatcgccaatttgtgttgcggcgatgttggttaacgcttcaccgaccgccagacgggcagaggcggcgaaatccagcagcgcaaccggcgcacgctcgccaatcgccatcgcttcaccgtagtagctgtcgaggctggcggtagtgaccgcgcagttagcgaccggcacctgccacggccccaccatctgatcgcgcgctaccatgccggttacgctgcggtcgccaatggtcaccaggaaggttttttccgccacagtcggcagatgcagcacacgtttcaccgcgtctgcaatggtgatcccttcacgggccagcgcgtcgcctttcgctttcagcgtttgtacatcgcgggtcatcttcggcgttttaccaagcaggacgtccagcggcagatcgatcggctgattatcaaaatgacgatcgtgcagagaaagatgcagttcttcggtcgcttcaccaatcaccgcgtagggtgcgcgctcacgcttacacagttcgtcaaacagcggtaattgatcggcagcaaccgccagcacgtagcgttcctgggattcgttacaccagatttccagcgggctcatgcccggttcgtcgcttagaatctcgcgcagttcaaatttaccgccgcgcccgccgtcgctcaccagttccggcatggcgttagaaagaccgccagcgccaacgtcgtggataaacaggattgggttggcatcaccaagctgccagcaacggtcgatcacttcctggcagcgacgctccatctccgggttgtcgcgctgtacggaagcaaagtcgaggtcggcatcagactgaccagacgccatagaagacgctgcaccaccgccaagaccgatgttcattgccgggccgccgagaacgaccagcttcgcaccgacgttgatctcgcctttttgtacgtgatcggcgcgaatgttgccgatcccgcccgccagcatgatcggtttgtgataaccgcgcagctcttcgccgttgtggctgttcactttttcttcataagtacggaagtagccgttcagtgccggacgaccaaattcgttgttaaacgccgcgccgcccagcgggccttcggtcatgatgtccagcgcggtgacaatgcgctcaggcttaccgaaatcttcttcccacggctgttcgaagccaggaattcgcaggttggaaacggagaaaccaaccagacccgctttcggctttgcgccgcgcccggtggcaccttcatcgcggatttcaccgccggaaccggtcgccgcgcccggccacggagaaatcgccgtcgggtggttgtgagtttcgactttcatcagaatatgcgccggttcctgatggaaatcgtagcggcccgtttcgtggtcagcaaagtagcggcccacttcagaaccttccattacggcggcgttatctttataagcagagagaacgtgatctggcgtggtttcgaaagtatttttgatcatcttgaacagcgatttcggctgctgttcaccatcgataacccagtcggcgttaaaaattttgtggcggcagtgctcggagttcgcctgggcaaacatatacagttcgatgtcgttcgggttacgaccaagctttgtgaaagcatcctgcagatagtcaatttcatcttccgccagagccaagccaagacgcaggttagcgtcgatcagcgcctgacggccctgccccagcaaatcaacgctggtaaccggagtcggttgatggtgggcaaacaactgctctgcatcatctaaagcaaaaaagaccgtttccatcatgcggtcgtgcagttcagcggtaacctgctgccattgttcattggtcagcgtaccggcttctatatagtaagcaacgccgcgctcaaggcggtttacctgttgtagcccgcagttatgggcaatatcggtcgctttcgaagaccagggagagatggtgccaggacgcggggtcaccagcaggagtttgccttgcggggcgtggctggcgagtgccgggccatatttcagcaggcgttcaagttgtgcgtgctcatcatcgtttaacggcgcattgaggtcagcaaaatggacatactcggcgtaaatattgtgaaccgggagcctggcagcctgaaaacgtgccagcagtttgttgattcggaatgccgacagtgcaggcgaaccacgcagaatttccatcataagtctctcgtcttctaagctttcggtgtacccaagggggggaaacgggcgtcattataaagaatctgatgcgctgacgaaaccgtttgcgtggaaataaaatcaccatcgtgaattagcaacgcgtgccgccaatggctgtaataagttgccatctggcgcaggtttacgcaaaatgccgctcatttatgagtaaacctttcactattattacgttttttcaagctgggacgcgcacgacacagagaattaactaattgaaaaaattaaagattaattatctgttcatcggcattctggcactgctgctcgcggtcgctctctggccatccattccctggtttggtaaagccgacaaccgtatcgccgccattcaagcgcggggagagttgcgtgtgagcaccattcatactcccctgacttataacgaaatcaacgggaaaccttttggcctggattacgaactggcgaaacagtttgccgattacctcggcgtaaaactgaaagtgaccgtgcggcagaatatcagccagctgtttgacgaccttgataatggtaacgccgacctgctggcggcaggacttgtctataacagtgagcgggtaaaaaattatcagcctggccctacctattattccgtgtcacaacaactggtttataaagtgggtcagtatcgcccacgtacgctgggcaacctgacggcggagcaactcaccgttgcaccgggtcatgtggtggttaacgatctccagaccctgaaagaaacaaaattcccggaattaagctggaaggtagacgacaaaaaaggctctgcggaattaatggaagatgtcatcgaaggaaaactcgattacaccattgctgattctgtcgccatcagcctgtttcagcgcgttcacccggagctcgccgtagcgctcgatatcaccgatgaacaaccggtgacttggtttagcccgttagatggcgataataccctttccgccgccctgctcgacttcttcaacgaaatgaatgaagacggtacgctggcacgcattgaagagaaatacctggggcatggcgatgattttgattacgtcgatacgcgcacatttttacgcgccgtcgatgcggtactgccgcagttaaagcccctgtttgagaaatacgccgaagaaattgactggcgtttgctggccgctattgcttatcaggaatcgcactgggatgcacaggccacttcaccgacgggtgtgcgcggcatgatgatgttaaccaaaaataccgcgcaaagcctcggcattacggatcgtaccgatgccgaacagagcatcagcggtggcgtgcgttatttgcaggatatgatgagtaaagtgccggaaagtgtgccggagaacgagcggatctggtttgccctcgctgcgtacaatatgggctatgcgcatatgctggatgcccgcgccctgacggcaaaaaccaaagggaatcctgacagttgggctgacgtaaaacagcgtctgcctttacttagccagaaaccctattacagcaagctgacttacggctacgctcgtggacatgaagcctacgcttatgtcgaaaatattcgtaagtatcagattagcctggtgggttatctgcaagagaaagagaagcaggctacagaagcggcgatgcaactggcgcaggattatccggcggtatcgcctacggagttgggcaaagagaaatttccttttctctcgtttctttcccagtcgtcatcaaactatttgacccattctccctctctgctgttttccaggaaagggagtgaagagaaacaaaattaatccgtcgaggattgcgcttttttctgcgctttaatttcctggcggcgcatgcgaaagaagtcactgagcaacgccgcgcactcatccgccagtattccttccgtaatttccactcggtgattcatacccggatgatgcagcacatccattaaagatcccgcagcgccagttttcgcgtcacgcgcaccaaagaccacgcgaccaatgcgactgtggatcatcgctccggcacacattacacatggttcaagcgtgacatacaacgtggcgtcgatcagacgataattttgcatcaccagaccaccctgccgcagggccatgatttctgcatgtgcggtgggatcatggcgaccaatcgggcggttccagccttcgccgattacccgattgttatgcactaataccgcgccgaccggcacttcccgctcatcccaggcacgtttcgccagcgtcagcgcgtgacgcatccagtattcgtggctaaattcgacttcagacaaaaagaaaactccggttataaaagcgcggcgcattatacacggacgctatgctttactctattccagttgctggagttcaccgcgcggggttactcgccaacgatgctgacagaaataaagcagcggattgtcctgattactgtcgctatagccactgtacagccgcagcggagtgccgattttgcgctccagttgtgcgaccttttcatgtcccagacaacgcatcgtcaatacccaaccaccatagccacgctgaatttggctggcgataagattaacccgcggcagccagggcgtatcgaaataaaccgcttcaaccagcggctgcggagagccggtaatcaaccagatatcagcatcggaacttaacaggtaggtggttaatcgctcctgaaccagcggaaaggcggtaacattgtcgcgaaaccagcgcacgaaatcggcctgcaacgtctgtaaacgtgcttcgctgtgaccaaaagtgcacccccacagaagcagactcatcggccagcgtgccgcacgaccttttatcaataacgcaatggctataatcggtaacaacggcaggacaagtaacgcattcagcggttggcgacgtagtaaatagcgcagaaaactgccgaacatatcctgctgatgcaatgttccatctaagtcaaaaaacaccacacgacgctcgtgagttgccaaaccatactcctctggactgaaacatcctgattaattttcgctactacatagcctaacagatagatcatcacttttccggcaacaatcgaccgcatcatggctaactggaatttttaattcatggcaattagcggcaatggaatataaaattcactcgcgtgtgtctcatattgcctgttgtcgccactatttcatcgcgaggaaagatatgaacggcttacttcgtatccgtcagcgttaccaggggcttgcccagagtgataaaaaactggcggattatctgctgctacaacctgatacggcgcgccatttaagctctcagcaactggccaacgaagccggagtcagtcagtccagcgtcgtgaagttcgcgcaaaaactcggctataaaggttttccggcgcttaagttggcgttgagtgaagcgctggcaagccagccggaatcaccctccgtgcccattcataaccaaatccgcggtgatgatccgttacggctggtcggcgaaaaactgattaaagaaaatactgccgctatgtacgcaacgctaaacgttaatagtgaagagaaactgcatgaatgcgtaacaatgttgcgctctgcgcggcggataattctgaccggtattggcgcttcgggtctggtggcgcaaaactttgcctggaagctgatgaagattggcttcaatgctgccgcagtgcgcgatatgcatgcgctactcgcaacagtacaggcgtcgtcccctgacgatctgttattagccatttcctacaccggtgtacgacgcgagttaaacctggcggcagatgagatgctgcgagtgggcggaaaagtgctggcgattaccggctttactccgaatgccctgcaacagcgtgcttctcattgcctgtataccattgccgaagaacaagcgacaaacagtgcttcaatctctgcttgtcacgctcagggaatgttaacggatttgctgttcattgcgctgattcagcaggatctggaactggcaccagaacgtattcgtcatagtgaagcgctggtgaaaaaactggtctgagtaaagaatgcgcgtataatgcccgcccggtttgtgttgttttgagagtttccttatggcgttgttaatcactaaaaaatgcatcaattgtgatatgtgtgaacccgaatgcccgaatgaggcgatttcaatgggagatcatatctacgagattaacagcgataagtgtaccgaatgcgtagggcactacgagacaccaacctgccagaaggtgtgcccgatccccaatactattgtgaaagatccggcgcatgtcgagacagaagaacagttgtgggataaatttgtgctgatgcaccacgcggataaaatttaatattctactctggaagtagagtattaattatattactgggaagccttaacgccattatatttatttaattgatgacattagcataatcattcactaagttaatttatatagtatctgcccagacacttatttatagttattaaaggtgcgtccgactggttcaccggacgcaccttaagtacgtttccttgtgttataagaacagaaggatcagctgtaaaacagcaatgatgattttgatgacccgtttaatcaggtatcggcaatcagtcattcgtttttccttaaacaaggaatgcagccattcagattagcccttacatctccccaaaactgaacgtgcgagttattgagggtgcatgctgcactccacaccagagctttgacgacaccactcgtttcaatgggggaattctgtggcatggtgtaaagcacagcaaaatcttcaataacgaagccaattttaatgtacttacgaattggcggtcacgttaatctttccatcaatattgctttcttcgtaaaggctcgagtttttatgctaaagattgcaagttgcttgtaaaagataagtacactgatccataatcgctgttgttgagggtgcatgctgcacaaaattaaagttaaaaagtaaaacccccgttccttaccagttcgggggttttactttttaaagagaacggtattatttttaactttcaataattaccgtggcacaagcatagtgccgctcatctgccagcgttacatgcatatttgcaacgcccagcttttccgccagttttaatgcctcgccccatagccgtagccgtggtttgccgagctcatcattgaatacttcaaattgattaaacgccagaccattgcggatcccggtgccaaacgcttttgctgcggcttctttcacagcaaaacgcttcgccagaaaacgcaccggctggtggtgcgttttccagatagcccattcgttatcgcttaatacgcggcgtgccaggcgatcaccggatcgggcgatcaccgcttcgatgcgagcgatctccacaatatccgtgcctaaacctaatattgccattagccacgcgcttccagcatcagacgcttcatttctgccaccgcatctttcagtccggtcatcactgcacgaccaataatggcatgaccgatattcagttcatgcatctcagggatggcggcaatggctttcacgttgtgataggtcagaccgtgtccggcgttaactttcagaccgaggcttgcggcaaaggtcgcggctttggcgatacgcgccagctcttgcgcctgttcggcgtcagttttggcatcagcatagcaaccggtgtggatctcgataaacggtgcgccaacctctgccgcagctttgatctgctcttcatcggcgtcaataaacagagaaacctgaatcccggcatctgccagacgtttgcaggcatcgcgcattttgtcacgctgccctgcgacatccaggccgccttcggttgttacttcctgacgcttttccggtaccaggcagcaaaaatgtggcttcgtctcaacggcgatcgccagcatctcttcggtcaccgccatctccagattcatgcgggtatccagcgtctgacgcaggatgcgcacgtcgcggtcagtaatgtgacggcgatcttcacgtaaatgcacggtaatgccgtccgctcccgcctgctcggcaataaacgcggcctgcaccggatccgggtaagcggtaccgcgcgcgttgcgcagcgtagcgatatggtcaatgttgacgcctaacagtaattcagccatgacaatcctcatcattcataatgtgttttcaccgttcgcttaggcataaactgccggaacagttccctgctctttaaaggtttaccgccaagatacggcttaagcgccatgcgggtaaagcgtttcgcggcgcgcagtgtgtctgcgtcaggaaattcccgtgcgtttaacgcttttaactgccttccggtgaacgttttattgtcgataacgacgcttgcgataaaccctttttcttcgcgataacgatacgtcatggtgtcatctaccggctcgccgctacccgcacaatgggtaaaattgacgccataacccagatgcccgagcagtgccagttcaaagcggcgcagcgcgggttctggcgtaccagtgacccctgcaagagactgaatgcagtgcaagtaatcgaaaaaaagttcagagaagcgcgtctcgtattccagtacgcgggagagaagttcgttgatgtacagaccgctgtaaagcgtgataccgcttaatggcagcgccagcgagacggcttcagcactgcgcagcgttttgacttcgccacgcccgccaaaacgtagcaagagaggggtgaaaggctgtaatgcacctttcagggtagagcgtttagagcgtgcgcctttggcaaccagacgcacgcgccccgattcctccgtgaagacgtccagcatcaggctggtttcgctccacgggcgactatgcaggacaaatgcgcgctgccagccttccatcggagttactcttaaagatcgtcaacgtaaccgagactgcgcagtgcgcgttcgtcgtcggcccaaccggatttcacttttacccacagttcaaggtgaacaggcgcttcgaacatttcctgcatgtctttacgcgcttcaatcccgatggttttgatcttggcccctttgttgccaatgaccatcttcttctgcccttcacgctcaacgagaatcaaaccgttgatgtcataaccaccgcgttcgttagagacgaaacgttcgatctccacggtcacggagtacggcagttcagcgccgaggaaacgcatcagtttttcgcggatgatttcagacgccataaaacgctgtgagcgatcggtgatgtaatcttccgggaagtgatgagtcgcttcaggtagatgcttacgcacgattgccgcaatagtgtcaacattcagcccggtttcggcagagattggcacgatatcgaggaagttcatctggcttgccaggaactgcaggtgcggcagcagatcggctttctcctgcacgttgtccactttgttcaccgcgaggattaccggcgctttgccttcgcgcagtttgttgagcaccatttcgtcgtccggcgtccagcgggtgccttcaacgacaaaaatcaccagctcaacatcgccaatagagctgctcgccgctttgttcatcaggcggttaatggcgcgtttttcttccatatgcaggcccggtgtatcgacgtagatcgcctgatacgcgccttcagtatggatccccacaatgcggtgacgagttgtctgcgccttgcgggaagtgatggagattttctgccccagcagtttgttcaacaatgtggatttgccaacgttcggacgtccgacgatggcaataaatccgcagtaacttttatcgatgctcattccagctccagttttttcaacgcctgttcggcggcagcctgctcagccttacgacggcttgaacctgtgccaaccaccggttcactcaggccgctgacctggcagtggatagtaaattcctgatcgtgcgcttcgccacgtacctggactaccagataagtcggcagcggcagatggcgaccctgcaaatattcttgcaagcgcgttttcggatctttttgtttatcgcctgggctaatttcgtccaaacgagtttgataccagttgaggattaatttctcgacggtttgaatatcactgtcgaggaatacgccaccaattaatgcttcgacggtgtcggcgagaattgactcacgacgaaatccaccgcttttaagttcacctggccctaaacgtaagcactcgcctaactcaaattcgcgcgccagttccgccagcgtattgccacggaccagcgtggcgcgcatccggctcatatcgccttcatccacacgagggaaacggtgataaagcgcattggcgataacgtagctcagaatagagtcgcctaaaaattctaaacgctcgttatgtttactgctggcactacgatgagttaatgcctgctgcaacagttcctgatgattaaaagtgtagcccagcttccgttgaagccgattaattacgatggggttcatgcgataccaataaataaatgcgtcaacaattcagcacacgaaacagacctgatatacatggttctgctaactgcttcgctgcagtttcagtttaccggtatatggggaccaacgctgtttcgtgtgccgtggcaacctggaggtgccaaccttaaacttcgggggaatattctatacacaacgacgggggatgtcgttagccacgggagatttatctcataaataattcacgttgtcgccataacggcgacaacgtgaacgaagatggctattaatggatgccgccaatgcgacttaagcgcagaccagtcggccattcgccttcttgcttatcgaagctcatccagatagccgttgcccgaccgaccagattcgcttccggcacaaagccccagtaacggctgtccgcgctgttgtcgcggttgtcgcccatcatgaagtattgtcccggaggaacaatccaggttgccagttgttgccctggctgctggtaatacatccccacctgatcctgcgcaatcggcactgtcagaatgcggtgcgtcacatcacccagtgtctctttacgctcggaaagacgaattccattttctttggtttcgtttttcggcacttcaaagaatccgctggtcgcttccccaccattacggcgtgagaaggtctgaacgaaatcgctcggttccacgtttgagtaggtgaccggcagcgcgttttcacacgcctggccggaactgcatcccggttgaatcgtcagctcttttgagaccggatcgtaagtgactttatcgcccggtaaacccaccgcgcgcttgatgtaatcaagctttggatcttccggatatttaaagaccacgatatcgccgcgtttcggatgaccggtttcgatcagcgttttctggtagataggatctttaatgccataagcaaacttctctaccagaataaaatcaccaattaacagagtcggcatcatcgaacctgacgggatctggaacggttcataaataaacgaacgcacaatcaatacgatagccagtaccggaaaaacagaagcaccggtttccagccagccaggcttcggcgcaacctttttcaacgttgctttatccagtgagtccccggcagccgcctgcgccgctgcctgacgttcccgccgtttaggtgcgaaaaagaatttatccacgcaccataaaatgcccgtcaccagtgtggcaatcaccagaatcagggcaaacatattcgccatgccaactcctaagggttatttgttgtctttgccgacgtgcagaatggcgaggaacgcttcctgcggcagctcgacgttaccgatctgcttcatgcgtttcttaccttctttctgcttctgcagcagctttttcttacggctgatatcgccgccataacatttagccagtacgtttttacgcagctgtttcacggtggatcgcgcaatgatgtgcgtaccaatcgctgcctgaatggcgatatcaaactgctggcgtgggatcagatctttcatcttctccaccaactcgcgaccgcggttttgcgaattatcacggtgggtgatcaacgccagcgcatcaacacgttcaccgttgattaatacgtctacacgtaccatgtcggacgcctggaagcgcttgaagttgtaatccagagacgcataaccacgcgaggtagatttcaggcgatcgaagaagtcgagcaccacttccgccatcgggatctcgtacgtcagcgccacctgattaccgtggtaaaccatattggtctgcacgccgcgtttttctacgcacaacgtaataacgttgccgagatatgcctgcggcagcagcatgtgacactctgcaatcggctcgcgcagttcgtagatgttatttaccgcaggcagcttggatgggctgtcgacgtagataacttctcttgacgtggtttcaacttcatacactacggtcggcgcagtggtgatcagatccagatcgtattcacgttccagacgttcctggatgatctccatgtgcagcaggccgaggaagccgcagcggaaaccaaagcccagcgcgctggagctttccggctcatagaacagtgaggcatcgttcaggctgagtttacccagcgcgtcacggaaggcttcatagtcgtcggaacttaccgggaacagaccggcgtatacctgcggtttgactttcttaaagccaggcagcgccttttctgccggattacgcgccagcgttaaggtatcgccgactggagcgccgtggatatctttaatcgcacatacgagccagcctacttcgccacatttcagttcagtgcggtcaacctgtttcggcgtgaagatgcccagacggtcggcgttataggtctgcccggtactcatgactttcactttgtcgcccttacgcagggtgccgtttttaatacggataagtgaaacaacgcccaggtagttgtcgaaccatgagtcgataattagtgcctgcaacgggccttccggatcgccttccggcggcggaatgtcgcgcaccagacgttcgagaacgtcctgcacaccaacgccggttttcgctgaacagcgcaccgcgtcggtggcgtcgatgccgacgatatcttcaatttcttccgccacgcgttcaggatcggctgccggcaggtcaatcttgttcagtaccggcacaacttcgagatccatttccatggcggtgtagcagtttgccagggtttgcgcttctacgccctgcccggcgtcgaccaccagcaatgcaccttcacaggcagccagcgaacgggaaacttcataggagaagtctacgtggcccggggtgtcgataaagttaagctgataggtttcgccgtcagacgctttgtagtccagcgtcacgctttgcgctttgatggtaatgccacgctcacgctcaagatccatggaatcgagaacctgcgcctccatttcacggtcagacaggccaccgcagatctggataatacggtcagacagcgtcgatttaccgtggtcaatgtgagctatgatcgaaaagttacgtatattcttcataaagtatgattattgtgccttaatgcccggttaaccaggcttttagaagtcgctgttctgagcttaacgtctgtattaatagaaacgccgcattctacactacaacattgaggcgaggaaatgttcataccgtatggattgtggtatctggaaacgtcctcgcatttgttatgcaaaatgcaacaaagccagtgaaatcactggctcgcgtcttccgaagatgtttcaaatcgcacaaggccaggcggcaatgccacgcttaagatgatcggttgccattctgcccgggcagcaaacttacgcgagtagccgcgcgcaatcaggaacccgccaataccaccgaggatcgcaccacataatgctgcgacgtcagaagcaaagagtagctgaaatagcgaagcgataaggaataatcccaccagcggcgacatataaaccagtaatgcggagctaagcaggctgccttcggcgatccccaattccactttttgccccggcactaacggctcatcacagggtacgacaatggtatgcgtggtttgcgggccaagtttatttaacacgcggctaccgcaaccggcgcgtgaagcgcagctgctgcatgaagctttaacatcacaactgaccagcgcctgcccgttttgccaggagacgacggtagcccactctttgatcattgcgctgccccgaacttaatattctcggcaatgcgtttcgccgtttgcggcggcagttcaccgacaatggtgatttcggcgttatcacgtacgcttgtactgacggttctgcgtccggtgcgcaacatctgatcggtgctcgatggcgtagcgcggttaacgtttaccgagaagctgaataatccgtcggaatagagacgtgattcgataggcatgttgtccatcgtcggtagcggacgtcgactactggaaacttcgctaaaaccctgtggcaaccaggttggcgtccagctgaatttagctttttcacctacaggaacagaaagcaacggcggcaaatttgccttcgccagcgtctgcatactgctgctgatatcctgattgacgttaaaagcaatcacgcgaaattgttccagcgtttcaccatcgcgatcaaggagatcaacccgcatcggtaatttcgattcggtgtccatccacacgatgtagctgtagcgtgtaccatctcgggcaaccacgcgaatgacttcgcaaagacgatcagcaatacgcgtgcgcccgacggagataaagtcgtagtaaggagaaaggcgtttgaaatcggtatagataagcgatggcagagaatcaacaatgtaatcgccattaagcgtgaacggttcaagtcccggttcaaaatagctgatttcattgccgcgctgtaccacttcccggcgcgggccatccatttgcaacaattgtgcaagaggacggttatcgaggcgtgcatgtcgataacgcagagactcaacaccctgtttattgatgctgatgaatgacagctcgtaattcagtgactgactggccaggttcatctgctgtaataacgccccggacgcgggagtggccgaggcgttagcagagaataacaggctacctgtcactaatgacatggcaaaccaaagttgcttcattactgcgattgcgttcctaaagtttgaattcctggcacctgtacagcggcttgctgggtttgcgcctgctcaaactgaagctgttcagagtggagtcggcgttgcagttcgtaatcctgcaacattgcattaatgcgacgacgctgctcctgtacctgctgctgttgaccattgtttgcggtcgcttcagaaggtactcccaggcttaccgggctggctttacccatcatcggcagtgtattaaataccggcgtttcgggctgctgggacgtttcagattgtccattatagtgctggacgccaacgataactgcaagcgatacgcatgcggctacgcccatttgggtaagctgtgccgcccacggacgtactttctgccagaatggcattttctgccattgatgcggcgcaggctgggcttccgggatcaatgtcgccggttgacgtactggctcttcttcaatggcggccatcacgcgtgaagagatatcgaaatggagcacctcgggagtatcaccccgcattgagtcacggattaagtgatagctttcccaggttttctgcatttctgggttatgagccagttcgttaagcagctcactatccagcgtttcgccatccattaaagcggaaagttgttctttctgcatgcctaatacccttatccagtatcccgctatcgtcaacgcctgataagcggttgaactttgttatcaatagcttccctcgctcggaagatacgtgaacgcaccgtacctaccggacaatccatgatagcggctatctcttcatagctcaggccatccagctcccgcaaggttattgccatgcgtaaatcttccgggagggactcaatagttcggaaaactatctgtctcagttcttctgacaacattaagttctcagggttcgaaatttctttcaacgcgccgccactttcgaagttttcagcttcaatggcatccacatcactggaaggtggacgacgcccctgagcaaccaggtaatttttcgctgtatttacagcaatccgatacagccatgtataaaaagcgctatctccccggaacgaatccagcgcacgataggctttaataaaagcttcttgtaccacatcgggaacatcacccgacggcacatagcgggaaaccagactcgccactttatgctgatagcgcactaccagtaagttaaaggctttctgatctcccttctggacccgttcaaccaggacctggtccgttaactgctcgctcatccgaggtaaagtctccccaaaccaaatttccacgcgctatcgaaacgccactccattagctgcaatttgagcaagcaaagggttagagtgtctcgtttttgtaaagttccgtaacgcatctgtttttgtttgtcatgctgtagacggatcattatctatcattataagtctacagaatctgaacatcgcattatctgtgtagaaatgcccatttaactgcctgaagagtaacccaacggcctttttatttcaccacctaatcctccaccagccagtaacttctctttttctcgccgccctgcgtcagcgtgtttagcaactgtaacaaatattaaaatagcaggtgtttatccgcacaacatgatgctatgctgaccaaaccatgtttagtaaattaaacaaagaaaatgaatactctccctgaacattcatgtgacgtgttgattatcggtagcggcgcagccggactttcactggcgctacgcctggctgaccagcatcaggtcatcgttctaagtaaaggcccggtaacggaaggttcaacattttatgcccagggcggtattgccgccgtgtttgatgaaactgacagcattgactcgcatgtggaagacacattgattgccggggctggtatttgcgatcgccatgcagttgaatttgtcgccagcaatgcacgatcctgtgtgcaatggctaatcgaccagggggtgttgtttgatacccacattcaaccgaatggcgaagaaagttaccatctgacccgtgaaggtggacatagtcaccgtcgtattcttcatgccgccgacgccaccggtagagaagtagaaaccacgctggtgagcaaggcgctgaaccatccgaatattcgcgtgctggagcgcagcaacgcggttgatctgattgtttctgacaaaattggcctgccgggcacgcgacgggttgttggcgcgtgggtatggaaccgtaataaagaaacggtggaaacctgccacgcaaaagcggtggtgctggcaaccggcggtgcgtcgaaggtttatcagtacaccaccaatccggatatttcttctggcgatggcattgctatggcgtggcgcgcaggctgccgggttgccaatctcgaatttaatcagttccaccctaccgcgctatatcacccacaggcacgcaatttcctgttaacagaagcactgcgcggcgaaggcgcttatctcaagcgcccggatggtacgcgttttatgcccgattttgatgagcgcggcgaactggccccgcgcgatattgtcgcccgcgccattgaccatgaaatgaaacgcctcggcgcagattgtatgttccttgatatcagccataagcccgccgattttattcgccagcatttcccgatgatttatgaaaagctgctcgggctggggattgatctcacacaagaaccggtaccgattgtgcctgctgcacattatacctgcggtggtgtaatggttgatgatcatgggcgtacggacgtcgagggcttgtatgccattggcgaggtgagttataccggcttacacggcgctaaccgcatggcctcgaattcattgctggagtgtctggtctatggctggtcggcggcggaagatatcaccagacgtatgccttatgcccacgacatcagtacgttaccgccgtgggatgaaagccgcgttgagaaccctgacgaacgggtagtaattcagcataactggcacgagctacgtctgtttatgtgggattacgttggcattgtgcgcacaacgaagcgcctggaacgcgccctgcggcggataaccatgctccaacaagaaatagacgaatattacgcccatttccgcgtctcaaataatttgctggagctgcgtaatctggtacaggttgccgagttgattgttcgctgtgcaatgatgcgtaaagagagtcgggggttgcatttcacgctggattatccggaactgctcacccattccggtccgtcgatcctttcccccggcaatcattacataaacagataaaaagcctgggtcagcgccgtatacgcttcggaatagttctggtctggcccacgaatgactaagcgatcgctaaagcattctcccgcctgcggggagaatgccagcagcacccgatgcggcagtcgcgcttcgttttccgccacatccgtccgcaaacgtaaatgccagcccatgcttaatgccagctccgtaaaaccattaccaatctgctctggcagcactacgcagaaaaatccctcttcggtaatgcactccgccgcacaggtcagcaacgatgggtgatcaagcgtagtggtatagcgagcctgttcccgttgaggtgtcgagcactctactccctgctgatagtaaggtgggttactgatgattaaatcgaagcgtactgtctgctgtgtgatccactgctgaatatccgccgtatggacgttaatccgctctgcccacggggactggttgatattttcctgcgcctgcgcggcagcttcactttccagttcaactgcatcaatcatcacgctgtcatcggttcgctgcgccagcattaatgccagcaacccgctacccgcgccgatatcaaggcaacgttttaccccagccaccggtgcccatgcgcccaataaaataccatccgttcccactttcatcgcacagcgatcgtgagcaacaaaaaactgtttaaaagtaaatccattacgacgaagcacggatgtagactgtgacatgaaaataaaaccttgcaggaaaaacggcgatagcaccgggtgagaacaatacccgagaagcgatatccatacaaacagatgaagattgcagccgtaacgtctataatcagcgccccacacagaggtagaacatgactgtaacgactttttccgaacttgaactcgacgaaagcctgctggaagccctccaggataaaggtttcactcgcccgaccgccattcaggctgccgccattccgcctgcgctcgatggccgtgatgtactcggttctgcgccgacaggcaccggtaaaacggcggcgtatctgctgccagcgttgcagcacctgctcgatttcccgcgtaagaaatccggtccgccgcgtattttgatcctcaccccaactcgcgagctggcgatgcaggtgtccgatcatgcccgcgaactggcgaaacatacgcatctggatatcgccaccatcaccggcggcgtagcctatatgaaccacgcggaagtgttcagcgaaaatcaggacatcgtggtcgccacgaccggacgtctgctgcaatacataaaagaagagaacttcgattgccgcgcggttgaaacgctgatcctcgacgaagcagaccgtatgctggatatgggcttcgctcaggatatcgaacatattgctggcgaaacgcgctggcgtaaacagaccctgctcttttcggcaacgctggaaggcgatgcgattcaggactttgccgagcgtctgctggaagatccggtggaagtttctgccaatccctccacccgtgagcgcaaaaaaattcatcagtggtattaccgcgccgatgatcttgagcataaaaccgcgttgctggtgcatctgttaaaacagccggaagcgacccgctcaattgtgtttgtgcgtaagcgtgagcgtgtgcatgagctggcaaactggctgcgcgaagcgggcatcaacaactgctatctcgaaggtgagatggtacagggcaagcgtaacgaagcgatcaagcgtttgaccgaaggtcgcgtaaacgtactggtcgcaaccgatgttgccgcgcgcggtatcgacattcctgacgtcagccacgtctttaacttcgatatgccgcgcagtggcgatacttatttgcaccgtatcggacgtaccgcgcgcgccggtcgtaaaggcaccgcaatttcgctggtggaagcccatgaccatctgctgctgggtaaagtaggccgctatattgaagagccaattaaagctcgcgttattgatgagttacgcccgaaaacgcgtgcgccaagcgaaaagcagaccggcaagccatcgaagaaagtactggctaaacgtgctgagaagaaaaaagctaaagagaaagagaagccgcgggtgaaaaaacgccatcgcgacaccaaaaatattggtaagcgccgtaaaccaagcggaacgggcgtgccaccgcaaacgacagaagagtaatctcaatgccaggtttaagcctggtattaaaagtgctggcaaacgcaaaactgcctgatgcgctacgcttatcaggcctacgtggctcatgcaatatattgaatttgcacgatcttgtaggccggataaggcgttcacgccgcatccggcatgaataaagcgcactttgtcgacaagttaaatgccgggtttaatcccgacattatttttatccagccacaaaactctcttcaacacactgaataaaagtgtgcatcgccgggctaaccgcttttccagcatgatgtgcgcacatggccgtaatggtctgcgactgttcgccaaaaggcaattcaattaattctccgcactccaactcttttgccaccgcaaagcgcggtaggtagctgaccccgatattcgccgcgacacaacgcttgatgctttcgatacttataagctcaatggtgttttccaccgtgatccgccgctgacgcagcgtgctctcaaatatctgccggaagacacattgcggttcgttgataataaagctacaggcgttatgtcttcccggctcagtaaaatcgacatctgcaatttgcggtgaagccaccagcaccagtgattgttcacccaactctcgtcgattcagagcatcatcattccctacacgataaaagacgccaacatcggcctcatcattcagtagcgcatcacggatcacgtaacagttcagcgactgcaacgataaacgcacttttggggcgcgttgccgaaaacgctgcaacacctgcggcattcggtaagagagcaacgtttcgcccgaaacaacgcgtagttccccgtccggatctgactcctttttggcagcctcacgaagcgtatccatcactcgggtaagttcataaatgtgcggcagcaacttttttccttcgcgggtaaggcacatccgtcggccaattttctcaaataactggactgaaaactcctgctcaagctgctgaatatgaaaagtcaccgtcgattgtgtacagcacaatttttgcgaagctcgcaaaaaggaaccctcttccaccacggttttaagcgtaataaaacggcgcagatccataaccccaaacctatcgaaaatatcgaatctagaatataaaaacattcatttttttaaatgttccgtgtcgggtactgtctaccaaaacagaggagataacaagtgacaccgacccttttaagtgctttttggacttacaccctgattaccgctatgacgccaggaccgaacaatattctcgcccttagctctgctacgtcgcatggatttcgtcaaagtacccgcgtgctggcagggatgagtctgggatttttgattgtgatgttactgtgtgcgggcatttcattttcactggcagtgattgacccggcagcggtacaccttttgagttgggcgggggcggcatatattgtctggctggcgtggaaaatcgccaccagcccaacaaaggaagacggacttcaggcaaaaccaatcagcttttgggccagctttgctttgcagtttgtgaacgtcaaaatcattttgtacggtgttacggcactgtcgacgtttgttctgccgcaaacacaggcgttaagctgggtagttggcgtcagcgttttgctggcgatgattgggacgtttggcaatgtgtgctgggcgctggcggggcatctgtttcagcgattgtttcgccagtatggtcgccagttaaatatcgtgcttgccctgttgctggtctattgcgcggtacgcattttctattaacgaaaaaaagcggaagaggtcgccctcttccgcttagtaacttgctacttaagccttacaggctttcagtaaaggtacgagcgataacgtcgcgctgctgttccggagtcagagagttaaagcgaactgcataaccggatacacggatggtcagctgcggatatttttccggatgcttaactgcatcttccagagtttcgcgacgcagaacgttaacgttcaggtgttgaccaccttcaacgcgaacttctggtttcacttctactggaacttcacggtattcaatgtcacccagtttgcttactgcaaccacttcatcttctgcataacctgcttttgcaacgatgcaacgcgcttcgcctttttcgctgtccagcagccagaaagagttcagcagatcgtcgttagcggctttagtaatctggatacctgtaatcatgtgatgcctccccggcaaaattatttgatttgttcagcctgtcgcggccaattggtaaaaccattgttgcttgagtgtatatatactcctcaaacacccttgaatctttgatttaaatcaataaaaaccacacatcaagtatggtcgcaaatggattttattgttttacatcaacttatgcgggtgtgaaattttaccaatttacatttttttgcactcgtttaagtctaaaaaatgagcatgattttgttctgtagaaagaagcagttaagctaggcggattgaagattcgcaggagagcgagatggctaacgaattaacctggcatgacgtgctggctgaagagaagcagcaaccctattttcttaatacccttcagaccgtcgccagcgagcggcagtccggcgtcactatctacccaccacaaaaagatgtctttaacgcgttccgctttacagagttgggtgacgttaaagtggtgattctcggccaggatccttatcacggaccgggacaggcgcatggtctggcattttccgttcgtcccggcattgccattcctccgtcattattgaatatgtataaagagctggaaaatactattccgggcttcacccgccctaatcatggttatcttgaaagctgggcgcgtcagggcgttctgctactcaatactgtgttgacggtacgcgcaggtcaggcgcattcccacgccagcctcggctgggaaaccttcaccgataaagtgatcagcctgattaaccagcatcgcgaaggcgtggtgtttttgttgtggggatcgcatgcgcaaaagaaaggggcgattatagataagcaacgccatcatgtactgaaagcaccgcatccgtcgccgctttcggcgcatcgtggattctttggctgcaaccattttgtgctggcaaatcagtggctggaacaacgtggcgagacgccgattgactggatgccagtattaccggcagagagtgagtaaatttgcggggaaatgccggatggcagagttgccacccggctgatttatcaggctttattctgacgccaccattcaccaagcaaaacgccggttgcgacagagatattcagcccggcaacgttgcccgtaccgtcaatcttcacgcgcagatcgttcggatcgcgtgcggcatccggtaacccttcatattcctgacccagcaccagtaccattttcgctggcagactagttttgaacagcggtttaccctgctcgctggaagtggtcactacggtgtaacctgcctgacggaaatcatccagcacgttaacaatgttgtcgccagtaatcggctgaacgtgctctgcgccgccttctgcggtacggatagccgcccccgactccagcagtgccgcatcctgcaccacgacacctttcacgccgaagtgcgcgcagctgcgcatcatgccacccaggttatgcgggttagattcgttttccagtgccagaacgcaatcctgcgcgcctgcctggcttacccactgctgcacggttgtaccgttacgctttttgatcaagaagcaaacgccgccgtgatgttccgtgcctgacgcttttgtcaattccgcttcatccaccacatggtacgctttgcggtttgctgccatccagcgcaaagcttctttaaaacgcggcgttacactctggataaaccaggcgcgaacaatcgcttccggacggctctggaaaagtgcctgacatgcattttcgccgtagacgcgggtttcttccgcacgctgacgacgcaacacttccggatcaataaaacttttaccactgatgccaccgtgatcggccttttccggcgtctcatcacccggcgcgcgggaaaccgtgcgccacggcgaatcttcccacttgcggtcacggggctgactctgtttgtcatcgcgggcggggcgacggccaccgtcagcacgagattttcctggacgcccgccccctttcccggtacgcgggttgtgggtacgtttatcagaatcatcatcactgcggacatacatcactttgaccttgccgcttttacctttcatttcatcgttcatgcttttctccaccagcgctgcgcgaagcgcgcagattacccgaagtccgcgcggttcgccatgatttcgtaccaaagcctgcgactatcatacctattgaataaaacagattgttgtctggaacaatgtccccgataatatgtaacatattagaaacataccggcgtcgttgccgataagtctccttactcatcccgaggttagttatgaataccgtttgtacccattgtcaggccatcaatcgcattcccgacgatcggatcgaagatgcggcaaaatgcggacgctgcggtcacgacttgtttgacggagaggtgattaatgcgaccggtgaaacactcgacaaattgctgaaggatgatctacctgtggtgatcgacttctgggcaccgtggtgcggcccctgccgtaatttcgcaccaatttttgaagatgtcgcgcaagagcgtagcggtaaagtgcgctttgtgaaagtgaataccgaagctgaacgtgaattgagcagtcgctttggaattcgtagtataccgacgatcatgattttcaaaaacggtcaggttgtcgacatgcttaatggcgcagtaccgaaagcgccgttcgatagctggctgaacgaatctctttaatcttaccggggcgcatcttgtgccccgttttctcctctgcgacaatggcgttttttcgacgctctcttatgaccgaaaacgctgttctccagttacgcgccgagcgtattgcgcgcgcaacacgtccttttcttgcccgcggtaatcgcgttcgtcgctgccaacgctgtcttttgccagagaaattatgtctctgttcgacaattaccccagcacaagcaaaaagtcgcttctgtttgctgatgttcgacaccgagccaatgaagcccagtaataccgggcgtctcattgctgatattttgcctgataccgttgcgtttcaatggtcgcgtaccgaaccctcgcaggatttgctggagttggtgcaaaacccggactatcagccaatggtggtctttcccgcttcgtatgctgatgagcaacgggaagtgatcttcacaccacctgccggtaagccaccgctgtttatcatgctcgatggtacctggccggaagctcgcaagatgtttcgtaaaagtccgtatctggataatcttcccgtcatttccgtcgatctttcccggctttctgcctatcgcctgcgtgaagcccaggctgaaggccaatattgtactgccgaggtagccatcgcactgttagatatggccggcgataccggggcggcggcagggttaggcgagcattttacccgctttaaaacacgctatctggcaggaaaaacgcaacatctgggtagcatcacagcagaacagttagaaagcgtttaaaatcattcggtcacttctgcgggagaccggtatgagtcagcgaggactggaagcactactgcgaccaaaatcgatagcggtaattggcgcgtcgatgaaacccaatcgcgcaggttacctgatgatgcgtaacctgctggcgggaggctttaacggaccggtactcccggtgacgccagcctggaaagcggtgttgggtgtgttggcctggccggatattgccagcttgccctttacacccgaccttgcggttttatgtaccaatgccagccgtaatcttgctcttctggaagagctcggcgagaaaggctgtaaaacctgcattattctttccgccccggcatcgcaacacgaagatctccgcgcctgcgccctgcgccataacatgcgcctgcttggaccaaacagtctgggtttactggctccctggcaaggtctgaatgccagcttttcgcctgtgccgattaaacgcggcaagctggcgtttatttcgcaatcggctgccgtctccaacaccatcctcgactgggcgcaacagcgtaagatgggcttttcctactttattgcgctcggcgacagcctggatatcgacgttgatgaattgcttgactatctggcacgcgacagtaaaaccagcgccatcctgctctatctcgaacagttaagcgacgcgcgacgctttgtttcggcggcccgtagtgcctcgcgtaataaaccgattctggtgattaaaagcggacgtagcccggcggcacagcgactgctcaacacgacggcaggaatggacccggcatgggatgcggctattcagcgtgccggtttgttgcgggtacaggacacccacgagctgttttcggcggtggaaacccttagccatatgcgcccgctacgtggcgaccggctgatgattatcagcaacggtgctgcgcctgccgcgctggcgctggatgccttatggtcacgcaatggcaagctggcaacgctaagcgaagaaacctgccagaaactgcgcgatgcactgccagaacatgtggcaatatctaacccgctcgatctacgcgatgacgccagcagtgagcactatattaaaacgctggatattctgctccacagccaggattttgacgcgctgatggttattcattcgcccagcgccgctgctcccgcaacagaaagcgcgcaagtattaattgaagcggtaaagcatcatccccgcagcaaatatgtctctttgctgacgaactggtgcggcgagcactcctcgcaagaggcacgacgtttattcagcgaagccgggctgccgacctaccgtaccccggaaggaaccatcactgcttttatgcatatggtggagtaccggcgtaatcagaagcaactacgcgaaacgccggcgttgcccagcaatctgacttccaataccgcagaagcgcatcttctgttgcaacaggcgattgccgaaggggctacgtcgctcgatacccatgaagttcagcccatcctgcaagcgtatggcatgaacacgctccctacctggattgccagcgatagcaccgaagcggtgcatattgccgaacagattggttatccggtggcgctgaaattgcgttcgccggatattccacataaatcggaagttcagggcgtcatgctttacctgcgtacagccaatgaagtccagcaagcggcgaacgctattttcgatcgcgtaaaaatggcctggccacaggcgcgggtccacggcctgttggtgcaaagtatggctaaccgtgctggcgctcaggagttgcgggttgtggttgagcacgatccggttttcgggccgttgatcatgctgggtgaaggcggtgtggagtggcgtcctgaagatcaagccgtcgtcgcactgccgccgctgaacatgaacctggcccgctatctggttattcaggggatcaaaagtaaaaagattcgtgcgcgcagtgcgctacgcccattggatgttgcaggcttgagccagcttctggtgcaggtttccaacttgattgtcgattgcccggaaattcagcgtctggatattcatcctttgctggcttctggcagtgaatttaccgcgctggatgtcacgctggatatctcgccgtttgaaggcgataacgagagtcggctggcagtgcgcccttatccgcatcagctggaagaatgggtagaattgaaaaacggtgaacgctgcttgttccgcccgattttgccagaagatgagccacaacttcagcaattcatttcgcgagtcaccaaagaagatctttattaccgctactttagcgagatcaacgaatttacccatgaagatttagccaacatgacacagatcgactacgatcgggaaatggcgtttgtagcggtacgacgtattgatcaaacggaagagatcctcggcgtcacgcgtgcgatttccgatcctgataacatcgatgccgaatttgctgtactggttcgctcggatctcaaagggttaggcttaggtcgacgcttaatggaaaagttgattacctatacgcgagatcacggactacaacgtctgaatggtattacgatgccaaacaatcgtggcatggtggcgctagcccgcaagctcgggtttaacgttgatatccagctcgaagaggggatcgttgggcttacgctaaatcttgcccagcgcgaggaatcatgagtaaggtactggaaatgttgaccacttaatcgggactggtgttattattgcccgcttatgtcgtctgcattgcacagaggacccttcaatgaacagagaagaaatgcactgtgatgttgtcaaaatttaagcgtaataaacatcaacaacaccttgcccaactacccaagatttctcaatcagttgatgatgtcgatttcttttacgctcccgccgacttccgggagacgctgctggaaaaaatagccagcgcgaagcagcgcatttgcattgtcgccctgtatctcgaacaggatgacggtggcaaaggcattctgaacgcgttgtatgaggctaaaaggcagcgtccggaactggatgtgcgggtgctggtcgactggcatcgtgcacaacgtggacgcattggcgctgcggcatctaacactaacgctgactggtactgccgcatggcgcaggaaaatccgggcgtagatgttccggtttatggcgttccaatcaatactcgtgaagcccttggtgttctgcactttaaaggctttatcatcgacgatagcgtactttatagcggtgccagcctgaacgatgtttacctgcatcagcacgataaatatcgctacgaccgttatcatctgatccgtaaccgtaagatgtcagacattatgtttgaatgggttacacagaatattatgaatggccgcggcgttaatcgtctggatgatgttaatcggccaaaaagcccggaaatcaagaacgatattcgtctgttccgccaggagctgcgtgatgccgcttatcatttccagggcgatgccgacaacgatcagctttctgtaacgccgctagtggggctggggaaatcgagtctgttgaacaagaccattttccatcttatgccttgtgccgagcagaaactaaccatctgtacgccatacttcaacctgccagcaatccttgtgcgcaatattatccagttgctgcgcgaagggaaaaaggtcgaaattattgttggtgataaaaccgcgaatgacttctacattccggaagatgaacctttcaagataattggcgcattgccttatctctatgagatcaatctgcgtcgtttcctgagccgtttgcagtattacgtcaatactgaccagctagtggttcggttatggaaagatgacgacaacacctatcacctgaaagggatgtgggttgatgataagtggatgttgatcaccggtaataacctgaacccgcgcgcctggcgtctggatctggaaaacgccattttgatccacgatccgcaacttgagctggcgccacagcgagagaaagaactggagctgatccgcgagcataccaccatcgttaagcactatcgcgatctgcaaagtattgccgattatccggtgaaggttcgtaaactcatccgccgtttgcgccgtatccgcatcgaccgattaattagccgcatcctgtaatcacaaccccgtcctgtacggggtttgttttttggaggccacgttttgcgtattctttttgtctgttcgctattgttactttctggatgcagccatatggctaacgatagctggagcgggcaggataaagctcaacactttatcgcctcggcgatgctttccgccgccggaaatgaatattcacagcatcaggggatgagccgggatcgcagtgccatgtttggattgatgttctctgtcagtttgggggcgtcaaaagagctttgggatagccgccccgaagggagcggctggagctggaaggatttggcctgggatgtcgccggtgcaagcaccggctataccgtctggcaactgacccgtcactaaagacgcatccccttccctttgcgatgtagcatcaaagaaaccagaaacgccaccacggccatcaaggtcacataccagaagaaggctgtttccattcctattgatttcagcgacaacgctacgtactccgccgaaccaccaaatatagcattagcgaccgcatatgacagaccaacgcctaatgcgcgaacctgtgccgggaacatctcagccttcagtattccactgattgatgtataaaaactcactatcagcagggcacacatcaccagaccaaaagcggcataaggcgaggaaacgttttgcaatgctgagagaataggaacggtaaaaatggctgccagcgaaccgaaacataacattgaggtacggcgaccaatcttatccgacagcgcgccaatgagtggttgaataagcatgaatacaaacaatgcggcagtcataatgccactcgccacgttggcatgcattcccgcagtatttaccagatacttctgcatataagtagtgaaggtatagaaacaaagggagcccgcagcggtaaaaccgagaaccatgatgaatgcacggcgattgcgccataatcctttcagagatccagcttcttttaaagcgcgcgtttcttgttgcgaagtttcatctaactgacgacgtaaccacaacgccacaacagctaacacagctcctaacgcgaaaggaatacgccatccccactctctgagtgcagcgtcttccatggtgtgttgtaaaaccacgacaaccagtagggctagcagttgtccgccgatcaacgtcacatactgaaatgatgcgtaaaaacctttgcgcccttcaacggcaacttcactcatataggtggcgctggtgccatattctccgccaacagataatccctgaaataaacgagcgagaagcaataatgccggagcccacgtacctatagtttcataacctgggaggcaggcgataaccagcgatccgaaacacatcatacacaccgataacagcatcgattttttgcgaccatgtttatcggctatgcggccaaatagccaaccgcctattgggcgcatcaggaatcccgcagcaaaaacacctgctgtttgtagtagttgagtcgtcgtgttcccggaagggaagaagatgtgggcaaagtagagtgaacagaacgagtagacatagaaatcgaaccactcgaccagattacctgaagaggcccccacaatcgcccaaatgcggcgacgagtatcactacttgtcagtttgctgtctgccgttacagtactttcagccatgccattatgtctcctgccgtaatccgatgcttttgtcggtcgcttttgtttattttttttgtaaaggaaatattatacatttgttgcatatcattatgcaaccttaaccatgaatttagttagcaggaaaatggttattgaggagcttaaggataaatttctggtaaggaggacacgtatggaagtgggcaagttggggaagccgtatccgttgctgaatctggcatatgtgggagtataagacgcgcagcgtcgcatcaggcatttttttctgcgccaatgcaaaaaggccatccgtcaggatggcctttcgcataatttgatgcctggcagttccctactctcgcatggggagaccccacactaccatcggcgctacggcgtttcacttctgagttcggcatggggtcaggtgggaccaccgcgctacggccgccaggcaaattctgttttatcagaccgcttctgcgttctgatttaatctgtatcaggctgaaaatcttctctcatccgccaaaacagcttcggcgttgtaaggttaagcctcacggttcattagtaccggttagctcaacgcatcgctgcgcttacacacccggcctatcaacgtcgtcgtcttcaacgttccttcaggacccttaaagggtcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggattacgggtcaacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttcgcttgcgctaaccccatcaattaaccttccggcaccgggcaggcgtcacaccgtatacgtccactttcgtgtttgcacagtgctgtgtttttaataaacagttgcagccagctggtatcttcgactgatttcagctccatccgcgagggacctcacctacatatcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcgcaggcttacagaacgctcccctacccaacaacgcataagcgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagtcgggatgacccccttgccgaaacagtgctctacccccggagatgaattcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttcccttcggctcccctattcggttaaccttgctacagaatataagtcgctgacccattatacaaaaggtacgcagtcacacgcctaagcgtgctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcatgtgcatttttgtgtacggggctgtcaccctgtatcgcgcgcctttccagacgcttccactaacacacacactgattcaggctctgggctgctccccgttcgctcgccgctactgggggaatctcggttgatttcttttcctcggggtacttagatgtttcagttcccccggttcgcctcattaacctatggattcagttaatgatagtgtgtcgaaacacactgggtttccccattcggaaatcgccggttataacggttcatatcaccttaccgacgcttatcgcagattagcacgtccttcatcgcctctgactgccagggcatccaccgtgtacgcttagtcgcttaacctcacaacccgaagatgtttcacttcagagttgcgaaaatttgagagactcacgaacaactttcattgttcagtgtttcaattttcagcttgatccagatttttaaagagcaaatatatcaaacaagacttaacagtctgttttgagatattgaggtcggcgactttcactcacaaaccagcaagtggcgtcccctaggggattcgaacccctgttaccgccgtgaaagggcggtgtcctgggcctctagacgaaggggacacgaaaattgcttatcacgcgttgcgtgatattttcgtgtagggtgagctttcattaatagaaagcgaacggccttattctcttcagcctcactcccaacgcgtaaacgccttgctattcacttttcatcagacaatctgtgtgagcactgcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacggttcccgaaggcacattctcatctctgaaaacttccgtggatgtcaagaccaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccacgcctcaagggcacaacctccaagtcgacatcgtttacggcgtggactaccagggtatctaatcctgtttgctccccacgctttcgcacctgagcgtcagtcttcgtccagggggccgccttcgccaccggtattcctccagatctctacgcatttcaccgctacacctggaattctacccccctctacgagactcaagcttgccagtatcagatgcagttcccaggttgagcccggggatttcacatctgacttaacaaaccgcctgcgtgcgctttacgcccagtaattccgattaacgcttgcaccctccgtattaccgcggctgctggcacggagttagccggtgcttcttctgcgggtaacgtcaatgagcaaaggtattaactttactcccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttaccccaccaacaagctaatcccatctgggcacatccgatggcaagaggcccgaaggtccccctctttggtcttgcgacattatgcggtattagctaccgtttccagtagttatccccctccatcaggcagcttcccagacattactcacccgtccgccactcgtcagcgaagcagcaagctgcttcctgttaccgttcgacttgcatgtgttaggcctgccgccagcgttcaatctgagccatgatcaaactcttcaatttaaaagtttgatgctcaaagaattaaacttcgtaatgaattacgtgttcactcttgagacttggtattcatttttcgtcttgcgacgttaagaatccgtatcttcgagtgcccacacagattgtctgataaattgttaaagagcagtgccgcttcgctttttctcagcggcgcggggtgtgcataatacgccttcccgctacagagtcaagcatttctttgcttttctctgttgagattctcaggagaaccccgccgacccggcggcgtgtttgccgttgttccgtgtcagtggtggcgcattatagggagttattccggcctgacaagcgaaaaatataaaaactttatcgttcgctcacttttcaggcaaaacatcttaaatatagtcttttccgtctaacttatagacaaaaacgagccccgaagggctcgttttatcatttactggacggcgacaatccggtcttcattaacttccaggcgaatcactttacccggaaccaattcaccagacagtatttgctgtgccagcgggttttcgatctgctgctgaattgcacgtttcagaggacgtgcaccatagaccggatcgtaaccgttctcgctcagcagtttcagcgcctcgtcagaaatgtggatttcataaccacgttcttccagacgtttgtacagacgtttcaactgaatctgcgcaatcgaggcaatgtgctgttcacccagcggatggaagaccaccacttcatcgatacggttaatgaattccggacggaagttatggcttaccacaccgagcaccagctctttcatgtgcgcataatccagttcaccgaagcgttcctgaatcagatcggaaccgaggttagaggtcataatgacgaccgtattacggaagtcgaccgttctcccttgcccgtcagtcagacgcccatcatccagtacctgcaacagaatgttgaagacatccggatgcgctttttccacttcatccagcaggatgacggaatacggacgacgacgcaccgcttcggtcaggtagccaccttcttcataaccgacatatcccggaggcgcaccaaccaaacgagacaccgagtgtttctccataaactcggacatatcgatacggaccatcgcctcgtcgctatcaaacataaagttcgccagcgccttacaaagctctgttttccccacaccagttgggccgaggaacaggaatgaaccaatcgggcgatttggatccgccagccccgcacggctacgacgaatagcgttagataccgcatcaaccgcttcgttctgaccaattacgcgatggtgcagttcttgctccatacgcagcagtttttcgcgctcgctttccatcatgcgagaaaccggaatccccgtccaacgcgccagcacttcagcaatttcggcgtcggtcactttattacgcaacagacgcatagttttgccttcgagctgcgttgcggcttccagttgcttttccagttccgggattttgccgtattgcagttcagacatccgcgccaggtcccccacacggcgagcctgttcaatagcgattttcgcctgttccagttccgctttaatggtctgcgtaccagaaagcgatgccttctctgctttccactcttcttctaactcggagtactgacgttctttgtcgctcagttcttcgttgagcatatccagacgttttttactggcttcatcagactctttcattaacgcctgttgttccagtttgagctggatgatacgacgatcgagtcggtcgagttcttctggttttgagtcaatctgcatacgaatgctggatgctgcttcatcgatcaggtcgatggctttatccggcagctgacggtcagcaatgtagcgatgagacaacgtcgccgctgcaacaattgccgggtcagtaatttgcacatggtggtgcaattcgtaacgttctttcaggccacgcagaatcgcaatggtatcttcaacagaaggctcggcaacaaacactttctggaaacgacgttccagcgcagcatctttttcaatgtactggcgatattcgtcaagcgtcgtggcacctacgcagtgcaattcaccacgcgccagcgccggtttcagcatgtttccggcgtccattgcgccatcggctttacccgcgccgaccatggtatgtaattcgtcgataaataggatgacgttgccttcctgtttggcaagatcgttaagcacgccttttaaacgttcttcaaactcaccgcgatatttcgccccagccaccagcgcgcccatatccagcgccagtacccggcggcctttcaacccttccggcacttcgccgttgataatacgctgcgccagaccttcaacgatggcagttttaccgacgccgggttcaccaatcagtaccgggttatttttagtacgacgttgcagcacctgaatggtacggcgaatttcttcatcacgaccaatcaccggatcgagtttgccctgttcggctcgttcggtaaggtcgatggtatattttttcaaagcctgacgttggtcttcagcaccttgatcgttcacgctttcacctccacgcatttgttcaatcgcttgagtaatgttggcggtggtcgcccctgctgctttcaggatgtcggccagcgtgccgcgagactcaagtgccgccagaacgaacagttctgacgagataaagttatcaccacgtttttgcgccagcttgtcgcaaagattaagaacgcgcaccagatcctgtgatggctggacatcaccaccagtaccttcaacctgcggtaaacgatttaatgcctgattgatatctgtgcgcaactggccagcatttatgccagcggatgttaataaaggactaaccgaacccccttcctgattcagcagggcgctcattaaatgaagtggttcgataaattggttgtcgtgcccgagtgcaagtgattgggcatcggcaagagcaagctggaatttattagtaagacgatccagacgcataactcctcccataacggatcaaagttgctactggagattaaatgaggtcatccctcaattattcaaggttattgaccagattaatgtgaaaagaaaatcacgcgtaccggatcgtcttgattctttaggttatatcagccaaatgaaacttgccatacgaccggtggtcttgtcgcgacgataagagaagaaagtctcattttccgtatatgtacaacggtcgccgccgaaaatttgctcaacacccacgttcgccagacgctgccgggcaagctgataaatatccgccagatacttatcaccatgctgaatgaaagctgcacttgctttagcgtctactgccataaacgcctcgcgaacctccccccccacttcgaacgcgcgtggaccaattgccggccctaaccaggcgagaatattttccggattatcagcaaaacaggaaaccgtctcttccagcacgcctgcgcacagtccacgccagccagcatgagcggcggcgacttccgttcccgctcgattgcaaaacagcacagggaggcagtcggcagtcatcactgcgcaaaccgtgccgggcgtattgctataagaggcatccgcccgttttgaggcataaggttcgccagtgagcttaagcacatctttgccgtgtacctgctcaagccagaccggtttagaaggcaaattgcccgcagcaaaaagtcgcttgcgattctcctcaacgtgatccgggttatcgccacaatgggcaccgaggttgagtgagtcatacgggggcaagctcacgccgccgatacgagtggagctacaggccgcaacaccttttggctgcggccactgcgggacaatcagcttactcataaccagtccacttcatccttatgttcttcgaaatcggcgcgcatcacctcaatcagctccaccatatcttgtggaataggcgcatgccattccatttcgatgccggagatcgggtgataaagacgcagcatggttgcatgtagcgcctggcggtcaaacttacgcagcgtggagataaatgcttccgaagcaccttttggcggacgcggacggccaccataaaccggatcgcccaccagcggatgagtgatatgggccatatgcacgcggatctggtgcgtacgtccagtttccagacgcaaccgcagacgcgtgtgcacacggaagtgttccatgatgcgatagtgagtcaccgctggtttgcccatcggatgcaccgccatatgggtacgtttggtcgggtggcgactgattggctcgtccaccgtgccacctgcggtcatatgaccaatcgccaccgcttcatactcacgagtaatttcacgccgttgcaaagattcgactaaacgcgtctgagccggaacggtttttgccacaaccatcaggccagtggtgtctttatccagacgatggacgatgcccgcacgcggtacatcggcaatgggtggatagtaatgaagcaacgcattcagtaccgtgccatccgggttacccgcgccaggatgtaccaccaggtcgcgcggtttattaatgataataatgtcttcatcttcatagacgatatccagcgggatatcctgcggttcaaaacgcgcttcttcttcaatctcagcgttgatggcaacctgctcgccacccaatactttttctttcggcttatcacaaactttgccgttaaccagcactcgctggtcgaggatccattcttttattcgcgaacgtgaataatccgggaacatttcggccaaagcctgatctaagcgttgaccgagttggttttcggacaccgttgcagtgagctgtactcgttgtgccatatatactgcttcttcgtttatcgttggggttttacggctttgccgtttaatatagtgtgctattgtagctggtcttaaccgggagcaggaacagagaatctcccgtattacattttgaggaaagtcaaaacgtcatgacgcgcatgaaatatctggtggcagccgccacactaagcctgtttttggcgggttgctcggggtcaaaggaagaagtacctgataatccgccaaatgaaatttacgcgactgcacaacaaaagctgcaggacggtaactggagacaggcaataacgcaactggaagcgttagataatcgctatccgtttggtccgtattcgcagcaggtgcagctggatctcatctacgcctactataaaaacgccgatttgccgttagcacaggctgccatcgatcgttttattcgccttaacccgacccatccgaatatcgattatgtcatgtacatgcgtggcctgaccaatatggcgctggatgacagtgcgctgcaagggttctttggcgtcgatcgtagcgatcgcgatcctcaacatgcacgagctgcgtttagtgacttttccaaactggtgcgcggctatccgaacagtcagtacaccaccgatgccaccaaacgtctggtattcctgaaagatcgtctggcgaaatatgaatactccgtggccgagtactatacagaacgtggcgcatgggttgccgtcgttaaccgcgtagaaggcatgttgcgcgactacccggatacccaggctacgcgtgatgcgctgccgctgatggaaaatgcataccgtcagatgcagatgaatgcgcaagctgaaaaagtagcgaaaatcatcgccgcaaacagcagcaatacataacagaaacctgaaacacaaaacggcagcccttgagctgccgtttttttattctgtcagttgtgaaactgaagcgatttagtcgctatcgatctcatcaaatatggctcgctttgagatattcctcaagtaaaaaaacatctcttcctgcgatttctcacaaaaaagattcgttgacaaaaagtgacaaaattatgagattttcatcacacattttgacatcaggaacggtatgctgaattcaccaagacgggaagacaagaggtaaaatttatgacaatgaacattaccagcaaacaaatggaaattactccggccatccgccaacatgtcgcagaccgtctcgccaaactggaaaaatggcaaacacatctgattaatccacatatcattctgtccaaagagccacaagggtttgttgctgacgccacaatcaatacacctaacggcgttctggttgccagtggtaaacatgaagatatgtacaccgcaattaacgaattgatcaacaagctggaacggcagctcaataaactgcagcacaaaggcgaagcacgtcgtgccgcaacatcggtgaaagacgccaacttcgtcgaagaagttgaagaagagtagtcctttatattgagtgtatcgccaacgcgccttcgggcgcgttttttgttgacagcgtgaaaacagtacgggtactgtactaaagtcacttaaggaaacaaacatgaaacacataccgtttttcttcgcattcttttttaccttcccctgaatgggaggcgtttcgtcgtgtgaaacagaatgcgaagacgaacaataaggcctcccaaatcggggggccttttttattgataacaaaaaggcaacactatgacatcggaaaacccgttactggcgctgcgagagaaaatcagcgcgctggatgaaaaattattagcgttactggcagaacggcgcgaactggccgtcgaggtgggaaaagccaaactgctctcgcatcgcccggtacgtgatattgatcgtgaacgcgatttgctggaaagattaattacgctcggtaaagcgcaccatctggacgcccattacattactcgcctgttccagctcatcattgaagattccgtattaactcagcaggctttgctccaacaacatctcaataaaattaatccgcactcagcacgcatcgcttttctcggccccaaaggttcttattcccatcttgcggcgcgccagtatgctgcccgtcactttgagcaattcattgaaagtggctgcgccaaatttgccgatatttttaatcaggtggaaaccggccaggccgactatgccgtcgtaccgattgaaaataccagctccggtgccataaacgacgtttacgatctgctgcaacataccagcttgtcgattgttggcgagatgacgttaactatcgaccattgtttgttggtctccggcactactgatttatccaccatcaatacggtctacagccatccgcagccattccagcaatgcagcaaattccttaatcgttatccgcactggaagattgaatataccgaaagtacgtctgcggcaatggaaaaggttgcacaggcaaaatcaccgcatgttgctgcgttgggaagcgaagctggcggcactttgtacggtttgcaggtactggagcgtattgaagcaaatcagcgacaaaacttcacccgatttgtggtgttggcgcgtaaagccattaacgtgtctgatcaggttccggcgaaaaccacgttgttaatggcgaccgggcaacaagccggtgcgctggttgaagcgttgctggtactgcgcaaccacaatctgattatgacccgtctggaatcacgcccgattcacggtaatccatgggaagagatgttctatctggatattcaggccaatcttgaatcagcggaaatgcaaaaagcattgaaagagttaggggaaatcacccgttcaatgaaggtattgggctgttacccaagtgagaacgtagtgcctgttgatccaacctgatgaaaaggtgccggatgatgtgaatcatccggcactggattattactggcgattgtcattcgcctgacgcaataacacgcggctttcactctgaaaacgctgtgcgtaatcgccgaaccagtgctccaccttgcggaaactgtcaataaacgcctgcttatcgccctgctccagcaactcaatcgcctcgccgaaacgcttatagtaacgtttgattaacgccagattacgctctgacgacataatgatgtcggcataaagctgcggatcctgagcaaacagtcgcccgaccatcgccagctcaaggcggtaaatcggcgaagagagcgccagaagttgctcaagctgaacattttcttctgccaggtgcagcccgtaagcaaaagtagcaaagtggcgcagtgcctgaataaacgccatattctgatcgtgctcgacggcgctaatacgatgcagccgagcgccccagacctgaatttgctccagaaaccattggtatgcttccggtttacgtccatcacaccagaccacaacttgctttgccaggctaccgctgtccggaccgaacatcgggtgtagccccagcaccggaccatcatgcgccaccagcatggcctgtaatggcccatttttcactgatgccagatcgaccagaatacaatctttcggtaaaggcggtaatttgccaataacttgctcagtaacgtggattggcacactaacaatcaccattccggcatcggcaacaatatcagccgctcgatcccagtcatgttgctccagaatccgcacctgataacccgagagggtcagcatcttctcgaacaggcgtcccatctgaccgccaccgccgacgataaccaccggacgcagtgacggacaaagtgttttaaatcctttgtcgttttcactggagtaagattcacgcatcacccgacgcaaaacatcctcaatcagatctggcggtacacccagagcttccgcctctgcacgacgcgaggccaacatagatgcctcgcgctccggaacataaataggcagtccaaagcggcttttcacctcgcccacttcagcaaccagttccagacgcttcgctaataaattcagcagcgctttatcgacttcatcaatttgatcgcgtaatgcggtcaattcagcaaccataataaacctcttaagccacgcgagccgtcagctgcccgttcagatcctgatgaatttcacgcagcaaggcatcggtcatttcccagctaatgcaggcatcggttacggatacaccgtatttcatttcactgcgcggttgctcggaagactgattgccctcgtggatattactttcgatcatcagaccaataattgagcgattgccatctttgatttgagcaaccacggattctgccaccgcaggctgacggcgataatctttattggaattaccgtggctgcaatctaccatcagagacgggcgcagtcccgcctgttccatctctttttcacattgcgcaacatccgcagggctatagttcggcgctttaccaccgcgcaggatcacatggccgtccggattcccctgagtttgtagcaacgcaacctgccctgcctggttaatgccaacaaaacggtgcggctgggcggcggcgcgcatagcgttaattgctgttgccagactgccgtcggtgccgtttttaaaaccaaccggcatggaaagcccggaggccatttcacggtgagtttgcgattccgttgtacgagcaccaattgctgaccagctaaacagatcgcccaggtattgcgggctattcggatctaacgcttccgtcgccagtggcagtcccatattcaccagctcaagcagcaatttacgcgcgatctgcagcccggcttctacatcaaaagagccatccatatggggatcgttaattaaccctttccagccgacagtggtacggggtttttcaaaatagacgcgcattaccagatagaggctatcgctgacctctgcggcaagggctttaaatcgacgagcatattccagagcagtttccggatcatgaatggaacaaggaccacatactaccagcagacgaggatcgcgcccggcgataatatctgaaatgcttttacgcgagtcagcaatctgggcttcttgttgcaggctcaatggaaaagcggccttcagttgttccggagtcattaaaacctgttcgtcggtaatatgtacgttattcagcgcgtctttttgcatgatggcgatcctgtttatgctcgtttgcgatagttgatcctcagcgaggatgacgtaacgataacacataaagtaaagttttcaatccatatttcgtacatttttatttacacaggcaatttagtcgcgctttcaacccttacctctgtatagataaatttacactccctttgaaaacaatccgctatgctttgaaaaaggagaaagaaatgatgaaaaagtttatcgcccccttgttggctttactggttagcggatgtcagattgatccttatactcacgcgccaaccttgaccagcaccgactggtatgatgtcggtatggaagatgcgatatcgggcagcgccataaaagatgacgatgcatttagcgattcacaggcggatcgcggtctataccttaaaggatatgccgaaggacaaaagaaaacttgccagaccgattttacttatgcccgaggactttccggtaaaagctttcctgccagctgcaacaatgttgaaaatgccagccaactgcatgaagtatggcaaaaaggggctgatgaaaatgccagcacaatacgattaaattaattaaaaccccacaaataaattaaacataagattttactcattgtgttttatttctcacattgatgacggtcgcatgaaaaaatgatattttaatgagcattctgaaaaaatatcgatgcatttcgagcgaagatggtggggatccctgaatgcgtttttctcaccgactgttcttacttctgattctcctgctgacgggagcaccaatactcgctcaggagccttctgacgttgcgaaaaacgtgcgtatgatggtttccggtattgtcagttacacccgctggcctgcgctatcagggccaccaaagttatgtatcttttcatcttcacgttttagtaccgccctacaagagaatgccgcgacatctttgccttatctgcctgtcatcattcacactcaacaagaggcgatgatttcaggctgcaatggtttttattttggcaacgagtcaccgacattccagatggaattaaccgaacaatatccgtcaaaggcgttattattaattgccgaacaaaataccgagtgcattattggtagcgccttttgtctgatcatccacaataatgacgtcagatttgccgtaaacctggatgccttatcgcgtagcggtgtaaaggtcaacccggatgtcttaatgctcgcacggaagaaaaatgatggataacgataattctcttaataagcgccccacgtttaaaagagcattacgcaacatcagtatgaccagcatatttatcactatgatgctgatctggttgctgctttccgtgacctcggtgctgaccctgaaacagtacgcgcaaaaaaacctggcactgacagcagcaacaatgacttacagtctggaagcagctgtcgtttttgccgatggccctgcagcaactgaaacactggcagcgctgggccagcaagggcaattttcaactgcagaagtacgtgataagcagcaaaatattctggcatcctggcattacacccgtaaggatccaggcgatactttcagtaatttcataagccactggctcttccctgcccccatcattcagccgattcgtcacaatggtgaaaccattggcgaagtacgcttaaccgctcgcgacagttcaatcagccattttatctggttttcgctcgccgtactgaccggttgtattctgctggcatcaggcatcgcaattaccctcacccgccatttgcacaatggcctggtagaagcgctgaaaaatatcaccgatgtcgtacatgatgtgcgttccaaccgcaatttttcccgacgagtttcggaagaacgtatcgctgagtttcaccgcttcgctctcgacttcaacagtctgctggatgaaatggaagagtggcagcttcgtttacaggctaaaaatgcgcagcttctacgtaccgcgctacatgacccattaaccgggctggctaaccgcgcagcgtttcgtagcggcatcaacacgttgatgaacaattccgatgcccgaaaaacgtcggcgttactatttcttgatggcgataatttcaaatacatcaatgatacctggggtcatgcgacgggcgatagagtcttgattgaaatcgcaaaacggttagctgaatttggcgggctgcgacataaagcataccgcctgggcggcgatgaattcgctatggtgctctatgatgtacagtcggaatctgaagtgcagcagatatgttcagcactgacacaaatctttaatctcccgtttgatcttcataatggccatcagaccaccatgacattaagcattggttacgcgatgaccattgagcacgcctctgcggaaaaattacaagagcttgccgatcacaatatgtatcaggccaaacaccagcgtgccgaaaagctggtgagataacaaggatatatcgatatgataaagcacctggtagcacccctggttttcacctcactaatactgactggctgccagtcccctcagggaaagtttactcctgagcaagtcgccgctatgcaatcttatggatttactgaatccgccggcgactggtcgctgggcttatcagatgccattctgttcgcaaaaaatgactacaaattgctcccggaaagccagcaacagatccaaaccatggcagctaaattggcctcgacagggctaacacatgcccgtatggatggacacaccgataactatggtgaagacagttacaacgaaggcttatcattgaaacgggcgaatgtcgtggccgatgcatgggctatgggtggacaaattccacgcagcaatctcaccacacagggtttaggaaaaaaatatcccatagccagtaacaagaccgcccagggccgcgccgagaaccgccgcgtcgcagtggtgattactaccccttaaaacaccagcaaacagataaaaaagggccagccaattggccagcccttcttaacaggatgtcgcttaagcgaaatcttagttaagacgctctttgatacgagcagccttaccagtacgctcacgcaggtagtacagtttagctttacgaacagcaccacgacgtttgacagaaatgctgtcaactaccggagagtgagtctggaagacacgctcaacgccttcgccgttggaaattttacgaacagtgaatgcagagtgcagaccgcggttacgaatagcgataaccacgccctcgaatgcctgcagacgttttttggaaccttcaacaacccatactttcacttccacggtatcacccggacggaaggaaggtacgtcctgcttcatctgctcttgttcaagttgcttaataatgttgctcataatttaatctcttatcctgggtaaactgatatctcgggggcttacgccatcccatcatgtttatgttgctgttgtgcgtgttccgttttgaactccgccagcaaccttgcttgctcttcagtcagagccaggttttccagaagttcaggtcttctaagccaggtacggcccagcgactgtttcaaacgccagcgacgtatctcggcatggttgcccgacagtaacactggcggaacttccatcccttctaacacctcaggccgcgtatagtgcgggcaatccagcaatccttcagcaaaggaatcttccgttgccgaggcttcatgtcccagtactcccggaataaaccgggaaacggagtcaatcagcgtcattgctggtaactcaccaccactgagaacgtaatcgccgattgaccattcttcgtcaatttcggtttggatcacgcgctcatctataccttcgtagcgaccgcacaccagaatcaatttttgattcgttgccagttcgctgacgcccgcttgatcaagcttgcgtccctgtggtgacagataaatcacctttgcgccttcacccgccgcggcttttgctgcatgaatggcgtcccgcaagggttgcaccatcattaacatccccggtccgccgccgtaaggacgatcgtccacggtacggtgccggtcatgcgtgaagtcgcgaggactccagctctggatgctcagcaggccatttttaactgcccggccagttaccccgtaatcggtaattgcgcggaacatttcaggaaacaggctaattatgccaatccacatagcgccgtcttttaccgtttatccggtggtttaaaaaccaggatcccaatctacttcgattgaacgagtagtgagatcgactttcttgataacctgcccatcgaggaacggtacgagacgttccttgataccaaacgcatctttcaggtttgccttaatgacgagaacgtcattagatccggtttccatcatatcgacgactttaccgagatcgtagccttcagtggttactacctggcagcccatcaggtctttccagtagtagtccccctcttcaagctgaggcagctgcgatgaatccacgacaatttcacaattcgtcagcaggttcgccgcatcacgatcgtcaacgcctttcagcttgatgatcatgtcctgattgtggtgcttccagctttccagctggacttgctgccactgacccgccttctggataaaccagggctgatagtcaaaaatgctttcggcgtcttcggtggaagaaaacactctgagccacccacgaataccgtaagacgaacccatttttcccaaaacgatgggatcaacaggtgcttgcgcggtgagttgtttgctcatcatgaccaccgtgacagattaagctgctttgtttacttctttgatcagcgcagcaacgcgatcagaaatagttgcgccctggccaacccagtgagcgatgcgatccagatccaggcgagtgccttcttctttttcgctagcgattgggttgaagaaaccaacgcgctcgatgaagcgaccgttgcgtgcattacggctgtcagcgacaacaacctggtagaacggacgctttttagcgccgtgacgtgctaaacgaatagttaccataacatcctcttgtgtgaataaaacaaccggaccccatcgaggaacggagtccggtgtcatattaaaagcccgaaaattttactcatttttgcgggaattgcaatcaacagttgctaactctgctgtaaaaggccgtcggcggtgcagccagtttggtgccggagtgcgcgcagtcaccggagcgtacacgcagtacgtgaggatgacgagcacatcccggtgccaaaatggcaaacaagccaggccgattagcgaccagggaagcctgggggcatcatacccttcatgcttctcatcatcttcgccattccgcccttcttcattttcttcatcatgcgctgcatgtcgtcgaactgtttcagaagacggttaacgtcctgcacctgcataccgcaaccggcagcaatacggcgtttacgcgaacctttgatgatttctggcttagcgcgctctttcatcgtcatcgagttgatgatggcttccatacgcaccagcactttatcgtccatctgtgacttgacgttatccgggatctgccccatgcccggcagcttgcccatcagactagccatgccgcccatatttttcatctggcgcagctgctcaagaaagtcgttgagatcgaagccgtcaccttttttcagcttgctggctaatttctctgcctgcgcgcggtcaactttgctttcgatatcttcgatcagcgacagtacgtcgcccatgccgagaatacgcgacgcgatgcggtccggatggaacggctccagcgcctcagttttctcgccaacaccgaggaacttgatcggtttgccagtgatgtgacgaatagagagcgccgcaccgccgcgggcatcgccgtccactttggtcaacactacgccggtaagcggtaacgcttcattgaatgcttttgccgtattggccgcatcctgaccggtcatggcgtcaaccacaaacagggtttcaaccgggttaatcgacgcatggacttgtttgatctcgtccatcatcgcttcgtcaacgtgcagacgaccagcggtatccaccagcagcacgtcgtagaatttcagtttggcttctttcagcgccgcgttaacgatatctaccggcttctgaccaacatcagaagggaagaaatcaacgcccacctgctctgccagcgtctcaagctgtttgattgccgccgggcgataaacgtcggcagaaaccaccagcactttcttcttgtgcttctcgcgcaggaacttaccgagtttaccaacgctggttgttttaccggcaccttgcaggcccgccatcagtacgaccgcaggcggttgcgcagccaggttcagggtctggttctcttcgcccatcgccgcaaccagttcgttacggactattttgacgaactcctgccccggcgtcaggctcttattaacttcatgaccaaccgctttctcttttacgcgattgataaactcacgcactaccggcagagctacgtccgcctccagcagcgccatgcgcacttcgcgcagcgtatcttttacgttgtcttcagtgaggcgtccacggccactgatattgcgcagcgtgcgcgacaaacgatcggttaaattatcaaacattgtctctcgcctggggtggaaacggttggccgcaatcgcgacacatcatcagtattttgccgcagtataacatgaaggcgtctttgttgttatgcaacggttggagcagcgttcacctgacgctatactgcttctctttcttattgctcaaactgtcgacatcactatgcccgtttttgctctgctcgcgcttgtcgcctactccgtcagtcttgcgctgattgttcccggtctgctgcaaaaaaacggcggctggcggcgcatggctattatttctgcggtcattgcgctggtctgccacgcaatcgctctggaagcccgcatcctgcccgacggtgatagcggacaaaacctcagcctgctgaacgttggttcattggtcagtttgatgatctgtacggtaatgaccattgtggcttctcgcaatcgtggctggctgctgctacccattgtctatgcctttgcgcttatcaacctggcgctggcaaccttcatgcccaatgaatacatcacccatctggaagctacgcctgggatgctggtgcacattggcttatcgctcttttcctatgccacgctaattatcgccgccctgtacgcgctgcaactggcgtggattgattaccaactgaagaacaagaagctggcgtttaaccaggaaatgccgccattgatgagtatcgagcgtaaaatgttccacatcacgcagattggcgtggtgctgctaacgctcacgctttgcactggcctgttctacatgcacaacttatttagcatggaaaatatcgacaaggctgtgctctctatcgtggcgtggtttgtctatattgtgctgctgtggggacattatcatgaaggatggcgtggacgccgcgtcgtctggtttaacgttgcgggcgcggtaattctgacactggcctacttcggcagccgaattgtccagcagttaatcagctaaacccagaaaaggagtttcccctggaacacatttctactactacgttgatcattattctgatcatcatggtggtcatttcagcctatttttccgggtccgaaaccggaatgatgaccctcaaccgctatcgtctgcgacatatggcgaaacagggtaatcgctcggccaaacgcgtcgaaaaattgctgcgtaagccagaccgcctgataagcctggtgttaatcggcaataacctggtcaatattcttgcctccgcgctcggcactattgttgggatgcgtttgtacggcgatgcgggcgtggcaattgcgactggtgtgctgacttttgtcgtactggtatttgctgaggtattgccgaaaaccattgccgcgctgtacccggaaaaagtcgcttatccgagtagttttctgctggctccgctgcaaattttgatgatgccgctggtctggttgctgaatgctatcacccgtatgctgatgcgcatgatgggtatcaaaaccgatatcgtggttagcggctctttgagcaaagaagagttgcgcactatcgtgcacgaatcacgctcacaaatttcccgtcgcaatcaggatatgctgctgtcggtgctcgatctggaaaaaatgaccgttgatgacatcatggtgccgcgcagtgaaattatcggtattgatatcaacgatgactggaaatcgattctgcgccaactctcccactcacctcacgggcgcatcgtgctctaccgtgattcgctggacgacgccatcagtatgctgcgagtacgtgaagcctggcggttgatgtcggagaaaaaagagttcaccaaagaaaccatgctgcgcgccgcggacgagatctattttgtgccggaaggtacgccgctcagcacgcagttggtaaagtttcagcgcaacaaaaagaaagtcggcctggtcgtcaacgagtatggagacattcaggggctggtgacggttgaagatattctggaagagattgtcggcgatttcactacgtcgatgtcgccaacacttgccgaagaggtcacgccgcaaaacgacggttcggtgattatcgatggcaccgccaacgtgcgggaaatcaacaaagcctttaactggcatctaccggaagatgatgcccgcacggttaatggcgtcattcttgaggcactggaagagatccctgtcgcaggcacccgcgtgcgtattggcgagtacgatatcgatattctcgacgtacaggacaatatgattaagcaggtaaaagtttttcctgtgaaaccgctgcgcgagagtgtggcggagtaacgaaaacggcccggcattcgcatgcagggccgtgaattattacgaaagcagaaattaagcttttgctttcgctacagtaaccatcgccgcacgaatcgtacgaccattcagcgtataacccttctgcataatgcccagtacgttacctggcgcaacgtcatcagattccaccattgcgatggcctgatgcacattcgggtccagtgggacgttagtttcggcgatcacttcaacgccaaacttacgcacaacatccagcatcgacttcagcgtcagctcaatgccttcaaccatcgcagacatatccgggttagctttatcagccacttccagcgcacgatccaggctatcaatcaccggcagcaattcgttgatgaatttctccagcgcgaatttgtgggctttttcaatatccagttcagtacgacgacgcaggttttccatttcggcttttacacgcaaaatgccgtcacgttcacgggtctgggcttcagccagctgagcttcgagattcgcaactttttcatcgcgcggatccacctgctcagcagaagcttctggctcaactgcctcaatctcttcgtgctgatccatgataatttcttccggggcttgcccctcaggcgttttctgttctttactactcatgaatttctccgcgtttttttcgcattcatctcgctaacttcgcttattatggggatcagtttcagggtttcaagggaagcactcacattgtcatcaatcttcgcaacaaggacctcggaaaaatgaataatcatttcaagtgtattggcattgtgggacacccacggcaccccactgcactgacaacacatgaaatgctctaccgctggctgtgcacaaaaggttacgaggtcatcgttgagcaacaaatcgctcacgaactgcaactgaagaatgtgaaaactggcacgctcgcggagattgggcaactagctgatctcgcggtagtcgttggtggcgacggtaatatgctgggcgcggcacgcacactcgcccgttacgatattaaagttattggaatcaaccgtggcaacctgggtttcctgactgaccttgaccccgataacgcccagcaacagttagccgatgtgctggaaggccactacatcagcgagaaacgttttttgctggaagcgcaagtctgtcagcaagattgccagaaacgcatcagcaccgcgataaatgaagtggtgcttcatccaggcaaagtggcgcatatgattgagttcgaagtgtatatcgacgagatctttgcgttttctcagcgatctgatggactaattatttcgacgccaacaggctccaccgcctattccctctctgcaggcggtcctattctgaccccctctctggatgcgattaccctggtgcccatgttcccgcatacgttgtcagcacgaccactggtcataaacagcagcagcacgatccgtctgcgtttttcgcatcgccgtaacgacctggaaatcagttgcgacagccagatagcactgccgattcaggaaggtgaagatgtcctgattcgtcgctgtgattaccatctgaatctgattcatccgaaagattacagttatttcaacacattaagcaccaagctcggctggtcaaaaaaattattctaattttacgccagcctctttactgtatataaaaccagtttatactgtacacaataacagtaatggtttttcatacaggaaaacgactatgttggcacaactgaccatcagcaactttgctatcgttcgtgagcttgagattgattttcatagcggcatgaccgtaataactggcgagaccggcgcgggtaaatctattgcaatagatgccctcggtctttgtctcggtggtcgcgctgaagccgacatggtgcgtaccggcgctgctcgcgctgacctgtgcgcccgtttttctctgaaagatacgccagcggctctgcgctggctggaagaaaaccagcttgaagacgggcatgaatgtttgcttcgtcgcgtgatcagcagcgatggtcgctcccgtggtttcatcaacggtacagctgttcctctgtcacaactgcgcgaactgggtcagttgctgattcagatccatggtcagcacgctcatcaattactcaccaaacctgagcaccaaaaattcctgcttgatggctatgccaatgaaacctctctactgcaggaaatgaccgcacgttatcagttgtggcatcaaagctgccgtgacctcgcgcatcatcaacagttaagtcaggaacgcgccgcccgtgcggaactgctgcaataccaattaaaagaacttaacgaatttaatccgcagcccggagagtttgaacaaatcgacgaagagtacaaacgtctggcgaacagcggtcaattgctgaccaccagccagaatgcattggcattaatggccgacggtgaagacgcaaacctgcaaagtcagctttacacggctaaacaactggtgagcgaattgattggcatggacagcaaactgtccggcgtacttgatatgctggaagaagctaccatccagattgctgaagccagcgatgaactgcgccactactgcgatcgtctggatctcgatcccaaccgactatttgaacttgaacagcgcatctcaaaacagatttcgctggcacgtaaacatcacgtcagccctgaggcattgccacagtattaccagtcgctactggaagaacagcagcaactggacgatcaggccgactcacaagaaacgcttgcgctggcggtaacgaaacatcatcagcaggcactggaaatcgcgcgcgcattacaccaacaacgccagcaatatgcagaagaacttgcacagctgatcaccgacagtatgcatgcgctctcaatgccgcatgggcagtttacgatcgatgttaaatttgacgagcatcacctgggcgctgacggtgccgatcgtattgagtttcgggtaaccaccaacccaggtcagccaatgcagcctattgccaaagtcgcatccggtggtgaattgtcccgcatcgcactggcaatccaggtcatcacggcgcgtaaaatggaaaccccggcactgatttttgatgaagtggatgtagggattagcggtccaacagcggcagttgtcggcaaactgctgcgtcaactcggcgaatcaactcaggtgatgtgtgttacccacctgccacaagtcgcgggatgtggtcatcaacactattttgtcagcaaagaaaccgatggtgcgatgacagaaacgcatatgcaatccctgaataaaaaagcgcggttacaagagctggcgcgcctgcttggtggcagtgaagtcacacgtaatacactggcgaatgcgaaagaactgcttgcagcgtaaacttttttcctgcttcacggtcagagtaaacagcaaaacgccgtaagaccggaaagcaaaaggttttaaagtgatgaaaggtctattatcatcggcatattacagatgagccacgtactgctcgggcccgaaaaggaatcaaatcactatgcgctgtaaaacgctgactgctgcagcagcagtactattgatgttgaccgcaggctgttccactctggagcgagtggtttaccgtcctgacatcaaccaggggaactatctgaccgctaacgacgtatccaaaatacgtgttggcatgacgcaacaacaagttgcgtacgcattgggtacaccgctgatgtccgatccatttggtacgaatacctggttctatgtcttccgccagcaaccaggtcatgaaggtgtaactcagcaaacgctgacgctgacctttaacagtagcggtgtgttgaccaatattgataacaaacctgcgctgagtggtaactaataataaagttgctctcaaagacgttaaaaaaggtgctcaatgagcaccttttttctgtctgttatttattcgctgatttttctgctcgttgcctgcgaagctctttcggatcggcaatgagagggcgataaatctccacccgatcgccatcatgcacactatcgcttagttttgccggacggctgtaaatgccgactttgtttttagttaaatcgatatcggtacgcaattccagcaagccactggcgcgaatagcttcttcaaccgtcgcgccctcctgcagcgtcactcgctgcaggtactgcttctcaggtagcgcataagccacctcaacggcaattttacctggcactgtaaacctctttcgcacgaaccgtaaaagcctggaccatattagccgccagctctttaaacacgcgaccaaaggcgagttcaatcaacttattggtaaactcaaagtcgagatgaaactcgatacgacacgcctcctggctcagcggcgtaaacttccatccaccaatcaatttcttgaacggcccatccaccagattcataagaatactttggttactggtcaactggttgcgggtagtaaacgttttgctgatcccagccttagagacatctaccgccgcagtcatctgcccaggagtggactccagaatccgacttccggtacaacccggcaaaaactgaggataagactgaacgtcattcactaactgatacatttgctccgcgctgtagggtaccagtgcggtccggctaatctgaggcataacaatttccatcaacaaaaatccaacaaataatatcatttatcctgctgtaaaaaaaacgctatcccggcgctgggtaacatcgggttcatgctaagatagagccttgtcccccgcaggattgatatggggtgttttcgatttcagattaccgatgattcacgacgcttatgacgaagaaaaaagcacataaacctggttcagcgaccatcgcgcttaacaagcgcgcccgtcacgaatactttatcgaagaagagttcgaagcgggacttgccctgcaaggctgggaagttaaatccctgcgcgcaggaaaagccaatatcagcgacagctacgtccttctgcgtgacggagaggcatttctgtttggcgctaacatcacgccaatggccgtggcctccacgcatgtggtgtgcgatcctacccgtacccgcaagttacttctcaaccagcgcgaactggactcattgtacggtcgcgtcaatcgagaaggctataccgtagtggcgctctccctgtactggaaaaatgcctggtgcaaagtgaaaatcggcgtcgccaaaggtaagaaacagcacgataaacgttcagatatcaaagagcgcgaatggcaggtggataaagcacgtatcatgaaaaacgcccaccgttaaacctgcactccaattattgaccagttcctcaccgcgcctccctctccggcggcgcgaatgaacatcttattggctatcacatccgacacaaatgttgccatcccattgcttaatcgaataaaaatcaggctacatgggtgctaaatctttaacgataacgccattgaggctggtcatggcgctcataaatctggtatacttacctttacacattggggctgattctggattcgacgggatttgcgaaacccaaggtgcatgccgaggggcggttggcctcgtaaaaagccgcaaaaaatagtcgcaaacgacgaaaactacgctttagcagcttaataacctgcttagagccctctctccctagcctccgctcttaggacggggatcaagagaggtcaaacccaaaagagatcgcgtggaagccctgcctggggttgaagcgttaaaacttaatcaggctagtttgttagtggcgtgtccgtccgcagctggcaagcgaatgtaaagactgactaagcatgtagtaccgaggatgtaggaatttcggacgcgggttcaactcccgccagctccaccaaaattctccatcggtgattaccagagtcatccgatgaagtcctaagagcccgcacggcgcaagccctgcgggcttttttgtgccctcaatttgtcccgcgaagtccgaagagaactaattaaatccgaaccttttaggcccattgataggcccaacgaaaagctctattgtttacgttgggcctaaacgcagggagactccccatggcaagaaaaaccaagccgttaactgatacggaaatcaaagccgccaaacctaaagatgccgattaccagctttatgacggtgacgggcttactctgttaatcaagtccagtggcagtaagctttggcaattccgttactatcggcctttgaccaagcagcgaaccaaacagagcttcggtgcctatcctgccgtctcgctttctgatgcacgtaaactcagagccgaatctaaagttttattggcgaaagacattgatcctcaggaacatcagaaagaacaggtgaggaattctcaagaggccaaaaccaataccttcttgttagttgccgagcgttggtggaatgtgaagaaaaccagcgtaacagaggactatgccgacgatatctggcgctcgcttgagagagatattttcccggcaatcggtgatatcagtatcactgagattaaggctcatactctggttaaagcagttcagccggttcaggccagaggtgcattagagactgttcgccgcctttgtcagcgtattaacgaagtcatgatttatgcgcagaacacaggcctgattgatgctgttcctagtgtaaatatcggaaaagctttcgagaaaccgcaaaagaaaaacatgccaagcatccggccggatcaacttccgcagctaatgcacaccatgcgtacggcaagtatcagcatgtccacaagatgcctgttcatgtggcaacttctaaccatcacccgccctgccgaagctgctgaggctcgatgggatgagatcgatttcaatgctagcgaatggaaaattcctgcagctcgaatgaagatgaaccgggaccatacggttccactatctgatggggctcttgctattctggaaatgatgaagcctctcagtggtggccgagaatttatctttcctagccgtatcaagcccaaccaaccaatgaatagccaaacagtgaatgcagcactcaagcgtgctggcttaggaggtgtacttgtttcacacggcttgcgttctatcgccagtacggcactcaatgaggaaggatttccacctgatgtcattgaagcagcgcttgctcatgtagacaaaaatgaggtgcgtcgcgcttataaccgcagtgattatcttgagcaacgtcgtccgatgatgcaatggtgggctgatctcgtaaaagcagcagatagtggtagcatcgttttaactcatttgagcaaaattcgtcttgtcggataaaatatttatcagcccagctctctgggctgatatttctaaaagatcgcactaaatagctacgcggaatagtgctctactttcgtttagccctttcagaggtaagacattagggcaatttcactgtatgactgcgcagtcatcgagtctgtggggtgttgctccttttgcaacgtatcacttgtcaataaatagaaagtgtagatgtattaggcgcagctatttagtctatatggcaagtagtaattatttacttcttttttttctacgaacagcgctatcgaaagcttgttttacatcttcattttttaaagaccattgatttaaaatagtatcaaccaaagcatcttgactcattgttgctacacgatattttttattttgattatttatctcaaactctgacatttgaataaaatcccatagcggttcgataagttcattaactgctacaaccttatttttccacccatcattcggaacagagtcattaattagctcaaccaacttcagttgaatgatatggtacacttccgctttgcttttgccacccttctttcctgcactccgcctgacttctgataattttttttgattacaaacagagatgttaaaccaagtcatacctatgcacttatcaaataactccgcagcccgatgaaatgctttaaaggcaacgttttcattttcagacatgatagattttccccagaaaaaagagattgaggcgaacataaggtgtgccttgaaaatgtcattaatggaaaatggctcgataacaagaggtaaaaacgtttccttggtaaggtttgaacttagatttttccagcattcttgagctggatcatataattcagtgtattcttcctttatctccagttgcccattcactgtatggtgccttgtttcccatggtacatcgcaggaatataacctcacacgagtacctattttctcagagctccagaattgctctcgcattctgcctagctcaatccgtatttccggatgatcttcctctagaacatcagtatccaccgcccattcgcattcggacatgtgataggcgagatcacgtcgttttctacaaatttgttcataaaaatcattcagagaaatcataaaaccaccataaatcaatgtattagaggttgtaaaaattgtatttttggtacatgggttttttgccttaaagatacccattaatctctctgcaaccaaagtgaaccaatgagaggcaacaagaatgaacaatcgatcggccgttagaatactacggttaccagcggttatccaaaaaacaggtatggcacgggccaccatctatgactggttgaaccccaaatcaccacgatacgatgccacctttcccaaaaagcgaatgctcggcgtgaaatctgtcggatggattgaggccgagattgatgagtggttatcacaacgctgtaaacttatttgagggtgttacatgaattcatactcaattgctgtcatcggagtgtaaacatcctgctatttccgccattaatagcggaatagccatatttgctaaacaatttcttaatttaattaaataagaggcattgcatgttcaatggtcgtcctttccctgtagatgcatttcctaaaattatcaggaatgcaatttatgaagtggaacagcatacgcaggcccctcaaggtttgattgctgcttctgctcttggggtaatttctcttgcctgtcagaaccggattgatgtttgccgattgaataatctacgtggcccggtatcacttttcttaatgactctggctgaatcaggtgaacgtaagagtacggttgataaactgctgatgaagccattatatcaactggaagaggatttatttgaaaaatacacccacgatcttaccgcatggagaaatgatgaagcaatttttaatattgaaaaaaaagcactgatgtcaaaacttaaatcagatattcgacgtaacaaagatcacttggcaacaaatgaaagacttaaagaactacttacgacaaacccgaaagctccagtgagattcaaatttttatttaacgatgccacacctgcagctattaaagctcatctctgtgggcactggcgatcagtcggcatcatgtctgatgaagctgggatcatttttaatggttacacacttaacgagctgccgtttatcaataagatgtgggatggttcaatatttacggtggaaaggaaaaacgagcccgagaaattaattagagatgcaagaataacactgtcgctgatggtccagcctaatgtttttaagggttatatcgacaggaaaggagatatggcaaaggggattggattttttgcacggtgcctcatgtgccagcctgcttcaacacaaggtaacagaaaaatttccaacccaattttttcaaatgaacatttgccggtatttcaccaacgtcttatggaaattgttaatgagagcatcattaaaattaatgaaaataatcgcatctgcctccgattctctgcagaagcagaaagacattggatcgaattctacaaccaggtcgagtcagaaatgagaatgattggccttctttatgattttaaggattatgcttctaaaatggcggagaacatggcgaggcttgctgccttacttcattacttcagcggtgatggaggcgatatatctgttaccgcagtaaaagcagcagtggagatagtggcttggtatattgaagaatacatccgcttgttctctaaaaaagaagagttttctttagatgtttcagaagcagatgagctttattgttggataaaagattactgcacgcaaaaattttcttcctgcatcaagaaaaatattatcttacaatttgggccaaataaatttagaaatcgtgacaaggcaaatgaattaattagaatcttaatttcacaaaacaaaatatttatatcttcatggggtaaaacaaaaataataaacataactcattgtgttttttgattttaatgacaatctaaaaggacttaatttaagagtaaaaacaaactctaaacccagttcggataaaagcttgtcatcttgataggtaatatataggtacatagacacatcagaacgatcacttactccaatatcattggccaggatactatatgacatacgatagtgaattcggatcacatgtatccctatatcgggatagaatcaaacaggttattgatgactccctaaacgaacatcttaactcaatgattctacgtgttgatctgcatgacccaattgatacagaaaatatggataacccattctttcaacccagggttgactctggtgctatatctcgctttaccagtgcgttaaaagcaaagcttaaacatgataagcatattaaaactcaacggaaagactggcctgatagtcgacattccactttacgttacgcatgggtcagagaatataccaaaaatagaaagcggcattaccatttgatactgtgtttcaatcaggatgcttattatcatttaggtgattacgacttaaaccgtaacacgttacgtacaatgataacgacagcttggtacagtgcacttggcatccctatagatagctcggggaagttagttaattacccgccaaatggcaaataccttctcaatcgtaaaagggacaactttgagcagacttatagcgatttgatgaatagggtggattacatgaccaaagtaaggactaaaatagtcggtgacggagaccgtaatttcggctgcagtcgcgggtaatttattttttacaacaatggcctttcttatggctggaaaggcctgatttgtttgtattaagatatcggtaatcttttgatggttggaagcccgtcctggtagacgacctagcctaccgaagatgtgagttattcaaaaatgtcgctttcccgcgttccgtagacaaacgtacctaaatcaatgtcgtctaataccgagcgcgcgcctgataaacatctgatcaacgtacccaatcgatctactccaaatgtcctgagtatcccgaagatactggctcaactcatccacatcagcctcgtcggaaaattccagcaagtctaccagtcggtgtaacgtctgaatgggaatgccaatctcttctaaggcattgacacctggtggtagatggaaactttcgaacgccaatttgacatgtgtgtaatcgactttgctgcgtataccacgctttacagcgtggtgtttaactacatcctccatcaagctgagcaccttaggtagggtatagccgaaggtattggttatgagcttcaaatcattgttgagggcaatggaaagagtacgtttctccccttcagaaatccactgtcgtgcataatcgatctgatttttcagatattccgaataactttcagcacttaaatagccggcaagttttgcgatcatgacatccgtaggcttaacagggaccccattgcgactgaacgtatggggaaccagtctggcaatgatctttgcaaaggtcttgaggaagtttgtcgcgggagtccagtgaaacactaacgaggaaaattcgttatcgtccatcatctcgaacatgctttgcagcatttcgaactgctcgacacggaagtacgaatgcttcttcacaaggtcgatggaaacacggtcgtttatgaaaacctcatcaaagcgatcctgtgaaaactcggacaagtggtctggttgaacgctggctaacaggttgattggggtatcaatgccctgaataccgagcggaatatccacctcttgattgagattgtcttccgggatttcctccaggcaaaagattttgccgacgaagtgaacgcccatgcgcccggcgcgacctttgatgttcccatgggtgaatttgtcaatgctgcgagttccatcgcggttgtcgtagatcacaacgttcttagcgatagtgttgactccttcaatgatcgtggaggtgcagagcaaaaagcgcagttttccagcattgaattggtcggcagtgtattgctgcagtgccctcggtagcgcgccaaaatgcaagccaataccgtttctaagggcgactgtgtaatcccagtcggcatcgaactcttcgctgacccagtcgacatggggattctcagtcggagtgccatgcccaagcctgatcagctcgcgcgccaccaggcccgcaacagttggtgacttgcaataaatgatcgttgcgtcgacacatgcgtgcgcgatttcccccagcgctttgagcttggctttgtcgtcattcgctttgatgccgaacgtcttaacatctagcgcgactgtattgaagtcggtagaaacgaaagtatgcggatatccaagtttttcgagaccgcgaatgctgttaacgaacggtcccgtcaggtaaaactgcctggagaccttaagcagtttgcttaacgcaatgttgagctcgatgactcgttcgtcttgatgatcaatgtccccgcttttcagttgtcggaacgccaacttgtaaaactcgtcaatgacgaagaggtcaatgtcgacgatgtcgtcacgctcgttcactcgctcctgagttaacacataaacagcctgatcggaatggcacacttgggaactgtggtggatgatctgatatcggtcaccgaatcgctcttgcagtcggcgacgggtttcgtcggcaagagccacggttggaacaaccagaacaagccgtttcaaagttcccatgccgagcaatgaatcgacgattgcacttttgcccatgcttgtaggtgcactcagcaccacgttttgaccagacttgagcagatcgaatatgtggaactgcattgagtggaaaacataaccatccgagaatggcgtccggtatagctcaagcaccctcaggtcatccggtgtcaggctggtgaactcctttttgagatacgggaacaaacctgattttctcaccatatttttcaaaattgtggtgtgctcggaaaaccgctcgcgcgaatcgagagctcgcacgatcaagtcccgtcccaagtcatacgaaacagggttagacaacagcttgttaaccgcaaacagataattgaacgatgagaagtcctcaccctgcaggctatgtttcgcctgttcatagatctctgtcatacgacctctctcaccttctcatcaactaattgggttaaccgctcaagactcggggctggataaatgaatacgtggatgcaaagattcgcaaacggcgaatcctcgatgaggtcagccgcgaatttttcgaacagcaccgctgtttctttctccaggtcatcctcgaaccccggcgtttcaggctcggttagtagattagagtcgtagcccacgaacagaacaaacgtgaaacgatcgaggtgagcatcgaaaggttggctgccatcaagaatttcgtcaatgtcgtggcgaagcaggtagttatcgtctttaatgtcgaggatttttttgcgcgcggtatcgatgcaatccgaaatgtcctcgtacaactgatcccgtatctccggcaatctgacggcaatgttaatatcagtcaccaactcgctgaagccaatccaaagctgatcaccttctggatcgcggcgaacgatatgcacgttttcaagaattttttcggcccctgctttttccacgtatagcatgcaaggaataggctggctttcgtggtgctgccggatcgttgcgtgcaacagcactcgacccaaaaattcgctgacgtcatggagcgatttgaagacggaattctttagtcgttctcgcttttcaatgaatgtcagtttatgaatatcagacatttcttttggtcggagaaaaacctcatccaaccattgacagacgttatccgcgatgtgcttgtagcggtatttcttaagtgagtactgctgatgtagaacctggcctttacgcttagcgcagaccgaagccataggcgctctaaatggcgtaaggatgtggggtaagtcccgtttgacgtagattttgcggcctgaccgagattggtcatcttcgacacgctgcttgaaccactcaagtaggtctggtcgtaagtaggacttgtcatcagcactgtgaatgcgtcgagaatgctcgcccttgcgcgtcacagtatcaaggatgcggcaccaaatgtcttcggcgacggtttcggaactgagaatgaccccatgtagatcttgggaggccagccgtatgttcttgatccctagaagttccagttcgcgcagggatgaaaacacttcccatgtagccgcatcgatccaatctgaaacgcttatacctgagtctgttaaaaaattgtctgtgcgtttgttgaggtcatcgatgagttcctgtcgacctggcttatctagtcgggcgtttgggctgatcgtcaagtactcaagggttttgttgaccttttcctctgtgacgatggagtacctacgtccaagggacaggtcagactcacactgcattgatttgtgcaaaattgaactgcaggggatcgtctttttatcagcaccttttgaattctgaacgatgtccgaaatgttccaacgtgttttgccggtgctttttacctgaacgaagtcgatgtatccatcagatacaatgtcgatatcgtctgtgacctcgcagcgcacactgcggatagtcttgtcacgaagcattcgggtgacatggtaagcggctacgcagtcctgaaataagaaaccgtgcttggcggctactccgcctgaatcgttcgactccatttagacatccgtgacaattttgcgaaaattaaggagatgttatgacacagtccaatcggatcactgcatcatcaccagtgatctaaatacttcacagccattctcggtcgcaggtatcaagcttttcaggattccacaaatattgtaaccctgacgtctaatttggttatataacatactgccccaactaacgtaaggtaggcacagccttaatcaaggttttggttttcaaatagttcagagctgagaccgccaaccgcactatggcactatggcactatggcactatggcactatggcactatggcaccgccagcgattgtaatcacacttgatattataaaacacagttgcacgcattatttcctggttggtagggtcatatctcgatgctctttgagcaatgtcaacatcgcgtgttcatggctttctatattgttgatgccttgcccatccggaccccactccttatagctcatcatgatggcttgttttgggctctctgctcgttctgtttcgacgtagaattttttcttgtctgctggcgaataattactaagtatcgagttgctgcttggtgagatcaggaagaggttaccgaaacgatggacatcatcccccattttgtggactgcccccccggtagacgatcctgccctatagttggagtgccccctattcaggtggctaaatttagcaaatcaatacacttcaggggggtattattgtagagtttccccatatgtttctatgggatccaggaaatgacaatcaggagttacaaaaacttaaatctggtcagggcaaatatcgagactgaatccagacaattcattgaaaataaaaactattcaatccaatcaattggtcctatgccagggtcaagggctgggcttcgggtcgtatttaccagaccaggggttaacttggcaactgtggacattttttataacggggacggttcgactacaattcaatatctcactggagccaatcgttctctgggccaagagttagcggatcatctttttgaaaccatcaatcctgctgaatttgagcaggtaaatatggtactgcaaggatttgtagagacaagcgttctacctgtacttgagctatcagcagatgaatcgcatatagagttcagagaacactctcgtaacgctcataccgtagtgtggaaaattatttccaccagctatcaggacgaattgactgtgagcctgcatatcacaacaggtaagctccagattcagggccgaccgctgtcatgttacagagttttcacgtttaacttggcagccctgcttgatttacagggtttggagaaagtgctaatccgccaggaggatggtaaagctaatattgttcaacaggaggttgcccgcacttacttgcagactgtaatggccgatgcttacccgcatctccacgtgactgccgaaaaattgctcgtttcagggctatgtgttaaactcgccgcccctgatttgcctgactactgtatgttactttatcctgaactacgcaccattgaaggtgtcttaaaaagtaagatgagtgggttaggcatgccagtacagcagccggcaggttttggaacttactttgataaacctgctgctcattacattctgaaaccgcaatttgcagctactcttagaccggaacagattaacatcatcagcacagcctatactttttttaatgtggaacgtcattctctgttccacatggaaactgtggtcgatgccagccgtatgatttctgatatggcccggttgatgggtaaagccactagagcgtggggaataatcaaggacttatatattgtttgaaatcaccggaattaacgtctcaggggctctaaaagctgtcgttatggcgaccggcttcgagaaccctttgtcctcagttaatgaaattgagacgaaactttctgccctactgggtagtgagaccactggtgaaatcctttttgacctcttgtgcgctaacggtccagagtggaaccgcttcgttacgctggaaatgaaatatggccggatcatgctggatacggccaaaattattgatgagcaggacgttccgacacatatcctgagcaaactgacttttactttacgtaatcatcctgagtacctagaagcctctgttttgtctcccgatgatgtacgccaagtcctgtcaatggatttttgaaactcttctttctaaacgaaccagtatagaattcgcccttttggcatgatattaacttgtccaatatgatcaaatagcattaaccccccctcacaacgtcctgcatagggaacacgttttcccctgtgcacccacgactaaatttccccccctttaaacttctcaataatgtcaccaattttctggaaatcctatgatgcctttcccggtaaatggtgctgtgagttcagaaagattctgcaatctatgtgcattgaaaaaatcttcagatagatatcattctcctgaacaatccgatgaacggcagaacctcgcggttctgccgtttttgttttacttttcagaggagtggtgatgaaaaattttgaagttctgcagccactacagaactccctttccggtctaccgctatgggtatctgaacgtatattgcagcagataaatcagttaacccactacgagccagtgatcggcatcatgggtaaaactggggcgggaaagagtagcctttgcaatgccctgtttgccggtgaagtatcgccggtcagcgatgtagcggcctgtacacgtgatcctttacgctttcgcctgcagattggagaacactttatgaccatcgtggatctgcccggcgtgggcgaaagtggcgttcgcgataccgagtatgctgcgctgtaccgcgaacaacttccccggctcgacctgattctgtggctgattaaggctgatgatcgggcactggcgactgatgagcatttttaccgtcaggtgattggcgaagcataccggcataagatgctgtttgttatcagccagtcagacaaagctgaacccaccagcggtggaaatatcctttccacagagcagaaacaaaatatcagccgcaaaatctgcctgctgcatgagctattccagcccgtgcatccggtgtgtgccgtgtcggttcgcctgcagtggggactaagggtgatggcagagcggatgattaagtgtctgccgcgtgaggccagcagcccggtagtagcgctactgcaacatccctttcgaacaacggtagcccgggagcaggcacgtgacgatttcggtgaaaccgtaggtgccatactcgatacggtaagcacctttccccttattcccgccccggtgcggaccattattcaggccgtgcgttcctcggtggtgtcagtggcccgcgctgtctgggatttcttcttctgagtgtttaattctgccctattattctccgagccctgtcgcaagtgcggcagggctttctttatttgttttacccatactgaggagtctgcttatgacccgtctggcttcgcgctttggcgctgcaaatcttattcgccgtgaccgtccgttaacccgtgaagagttatttcgcgtggtgcccagcgtattcagtgaggataaacacgaatcccgcagtgaacgctacacgtatatacccacaatttccctgctggacagcctgcagcgggaaggcttccagccattctttgcctgtcagacacgggtacgtgacccccgtcgtcgtgagcatactaagcatatgctgcgcctacgtcgggaggggcaaattaccggtaaacaggttccggaaattatcctgcttaactctcacgatggcaccagttcgtaccagatgctgccgggcatgttcagggcggtgtgccagaacggtctggtctgcggcgagtcgtttggcgaggtgcgggtgccacacaagggggatgtggtgagtcaggttattgagggggcgtatgaagtgctggggatttttgagcgtgtggaagaaaagagggatgccatgcagtcgttgcttttaccgccacctgtgcagcaggcactggcaaaagcagcgcttacgtatcgctttggtgaggaccaccagccggttactgaatcgcagatactctccccacgccgctggcaggatgagagcaatgacctttggaccacctatcagcggattcaagaaaacctgattaagggcggactcagtgggcgtaatgctaaaggcggacgaactcatactcgtgccgtgcgtggcattgacggggatgtgaagcttaaccgtgcgctgtgggtgatggcagaaacactgctcacgcaactgcagtagacgtttcatgttgccacgttgttaatatcggacaccacctgtccgcatcgctatgtgctcgtgtgcctcaatcccccggttatagcttttaacccccgttacatctggcttttgcagaaataaaaaatagtttctgcgttgtccataccctgtccgcccccctctttaaagtaatcacatcattttcagtcagttaactttcctggagaatctctcatgacacaggcagaacgccgccatgaccggctggctgtcaggctgtcactgataatcagccgtctggttgcgggtgaaacgttgagcgtgcgcaaactggcggctgagtttggcgtgtcagtgcgcacgctgcggcgtgattttcgtgaacgactgatgtatctggacctggagtatcagtccggatactgccgcttacgcactgctggcagtgagatgcagatggtgcccgacgtgcttatctttgcccaccgcagcgggctggccgggctttttcccggccttgaccgccgtctggtgaatgcactgctgatgtgcgatgagtctccctgcgtgatagcaccagccaatccggttccttcgccttcaggagcattgtctttctggagactgattcaggccattaccgggcgcaggcgggtgacgctgattgcagaggggcgacgctgtgagcgcctagctccctgccggttactcatccaccagcagacctggtatctggtggctgaacacgaagggcatatcgccgtattcacacttgatgaaatccatctgattcagcctttgcaggagacttttcgccgcaatgacagtctgtgtcgcctggttgaagacccggtcttcattcaggccttaccccattttcgctttatccagcattcactgcttacgtttgttccggccgacagcccaccggaatagcgcaggcgttgttatcaacccggcaacatggaggagcccagtgcccgttattgccattatcgccattgttatcatcgtcatcattctgaacaaaaccggagtgtccgacagcctcacggccctgacacttgcaaccgttgccgcactactgacgggaggtggtgcagccggtgctgccagtgtcgcgctgacgccgttcgtcggcgtgccggtgggtatttttgtgggaatttatgtctttgccaaagtggttcgtctgatttcagggaaaaaataatgaaacgtaaaacactacctctgctggcgctggttgccacctctctgtttctgagcgcctgcgatgacaggagtgatgacctcaaagctatcagtaaatttaaggacctcacgcccccgcgcttcagcgatgtggtcagccgtcaggatgatgtcagcgaagaatggtcacaggttggcttctcatccggtctcaccctgcaggtcttacgtacccgtgagtcgcccgatggttgcgagggtggcagttactactatctggtagatatggaggagaaaaccgtccagccgctgatgaatgcgctttgtattgccgacaatatcaaactggaataccacgaagttacggacccgtatacgaaagaaaaatacttcgaatattcccatgacggcaaactgatgggacggctgctgataccgtcaaaccctgataaccgggaataaaaacaacgagaaaggagacataaatgaaaatacgttcactaagccggtttgtactggcaagtacaatgttcgccagctttacagcctctgcggtccccggactctggcaacaggggtacggtcagggcaatgcggaatacagtgtgacggatgccagcggaaagatgtttaccatcaactgcacgggaaatccggaccagaacggtatttaccagcactcggtttttctgatcctcgccggggataaaacggtcagctcgcatgatgacagtaccggcatcacagtggtgatggaccataagcaatatgccattccctcaacccttggctggcgtaacggagataatgcctggttcagcttcatcatggatatccgtaaggcccggcagttcgacgtctacgtcaatgaccagaaagttggatcgtttaaccctgatgttcggaatgcacaaaaggtcctgccaacattagcggactgcactaacgactgacggctgcgccttccctaccataacaaccctgattgcctccggcggtcgggggtttcttttttctccttaatctccagaggtaggccacgtactttcgaacgatgagcgcagtggtcagtttttttcagatatatttatctttttttggctgtaagctccgctgtgagcgcaggctgtgttaaaactcctgatcactttttggtctaagcgatggtttcatatgatcaaccattcttgataaacccatgagacggactaactttttcattaaaattaaaaagatatgaatgaatactgcggatatcaacatggccaatcacattcaaggacaaggcaggcatcaggtgacattgctccctgatgcactcgatgattttgtcactgaagatatctgaaataagtttaatcagttcatcacgggtcggtggcatatcgagataattaattattgtcggttcgttgccgttgttatgaagcatctccagcgtgttgcgtgaggtgccacaggccgggttgtgatagatggtaatgttgctcatatcagtatctaattacaaagtgacagagagccgccacgccagcgcggccagagtgacaaacagcaccggcacagtcatgacaatgccggtacggaagtaatatccccaagtgattgtcatatttttctgggcaagcacatgcagccacagcagagttgccagactgccaatcggggtgattttcgggcctaaatcacagccaatcacattggcataaatcattgcctctttgacgacgccagtcgccgtactcccgtcaatcgacagcgcaccaatcagcaccgtcggcatattgttcatcactgatgagagaaatgccgtcaagaagccggtgccgaacgtcgctgcccataaccccttgtctgccagcagattcagcacgccagacaggtactccgtgaaccctgcattgcgcaggccatagaccacgatgtacatgcccagtgagaaaataacgatctgccatggcgcaccgcgcaggacttttccggtgttgatcgaatgacctcttttcgccaccacaaacagcactgctgcgccagcggccgctatcgcactgaccaggattccctgcggctccagaaagaagaaaccgacaagcagcaataacaggacaatccagcccgccctgaaggttgccagatccttgatcgcactggcaggcgtcttcagcagcgaaacttaatacgttgccggaataactctgcgaaagaagagatacagcataatcagcgtggccgcaatcgctgccgcatccacggagatcataacggaggcgtactgcgcaaagctcagaccgaagaagtccgccgagacgatattcaccaggttagaaacaatgagcggcaggctggccgtatctgcaataaatcctgcagccatgacaaaggccagtgtcgtgccctggctgaacccagtgcgatcagcatcgcaatcacaatcggcgtcaggatcagcgcggcgccgtcattggcaaacaacgcatcaacagcggcaccgagcaagactttccaggtgaacagcgctctaggtaggaactttgtcgttgatagagtcttcagccatcaacactgtatcgagtaatgaaattggttgctagaaagtcgatgatttgttgcgtatgattaaaaatcaaccttaaaggctttatacatggatttgctatggcttttgtatcagaaagagaaattgtaagaaagatatttagcaaaaaaattgactttacgatcttggcatttttctatatttcctctattttttttcttctttgtagtggcgttctctttcaatattttaccgctgccttcacaaaaggtaattgttatgaatgctcaatgaaacttgattacataaaacaattttatttttcactggaaaccgcatggtacctcatatctgctgttgcagtatttattgcatctgtttttatacagcatagaattaaagcttatttaacattattagctattacatggattgtactaacaataacagatgtggcgttaatacacgccttagacaatatagccatgaataatattttgttaaatatactatataatctttttggggcgattttattgtcactgtttatgtgtttatcaaattccctccttttccaccttaataagataaaacatattccaatgattttatcggcaatgattccattagtttccgcaataataatagccatactcataaccgctgttatatatttattgtttgcccggcaggcggtagagattgagatggatatatctgaaggttcagacatcgcatatgtaggtgtaaaagataatgaggaatcatttgggtttttaaatgataaaaaaacagacacaccaacgtatctggatgtaatcaaaaatggtagtttgatatataatgatacacagggtttaagtggtgctgatatttatattgtctccggttgttatgcccttccagatttacttcgcaatgtaccgcttgatgctaaaaaatcttttctgaatgtaaaaaagctagaaatcacacagaaacttccaatgatggggttcatacaaggtgaatccgctgatgtgatgcctaaagcagcatccaggttaagtttgagcaagcaagatgataaatttatgctagcctcaagtgttactgactctcaaataaaatttaaatcaaacaatgcacaattgatggttgctttcgcatttatgccaataacaacgaatggtattttacatgattatacatacgatataataataaatgataaaaaatataaaattgaaaatcatgttgcacctctatctaggcttgataaaaataagaagatgaagtgtgaataccagcaaatatcggatttaacaaatacgtataacattaatgcaaattacttaacgggttttttacttgtcctaaaaccagatgatattattaattacaacaatagcccttccgtactactcaagactgattttgcgttctataaaaaaacataccagaagcttgataaaatatatgatgacataagcaatggaaaattatcttcactgagagcaacaggtatctcccagtttagtatcaacgggaaacatttgtcgttaaggccagaatcggagattattatttctgaagggagtttgtatggactagttaataaaagcaaaaaaatcaaaatatatggcacagcagatcttgtttttgttgataacaagataatgaaccttcgtaaaataacttatttgcaatctaagctagaaatttttggttcttctattatggatatattaaagtatatatttggtttaggtctgctagcaatttctataaaattcattcattcttactttaagaatgatgtgaatgaaaatttattcttgtaacgcatttggctccaattggagcctttttatgactatttattaaaatatcctaagttaagcctgtttttaaagcaggcttgagcgtgaagcggacactcatacctgctttaaagtggcgtttttgtcgttacccatacctatattttctgttgtttaactgccagaactgagcggttgaaaagccagaaatatgccgagccagcggcatggaagcgccagcagctgttgaatggagtactgtaggcaaatggtgccgtaaccggctttcgtactgaaaggttctgtctatcccatcccttctcttgtatctaacatttagttgtgaatagctactgtaaatgcccctacaaaatgaaccattatttttagagggcgtctggcactccaacttccgcttttggcacagaacggcctatcagcaatataaaagcattcagatatatatcatttctacaaacatacccgattaacggcagaatctcaggattctgccgcttttttattatttttcaggggagtagtaatgagcaactctgaaggttggtagtcattttagcaaacgctttctggtctgccgcagtgggcatcggctgattgcgtagcagggccactggtatctgccggtatcaccgacattaacattgaagacgaccagggcattcacgtccgcctgatagttcgtgatgccgaaggtcggatggttggcgggcatggaactttgaaccggacgccggtgaaggttttaaccgctatatccacaggtcaggcatccgcaccgacaccttcccccgctgactccgaatcatttaccagcaacatttcaccttcccaaacgcgctttattacctcatacgccagccatcgccgctggcgttttttattcacggagacatacccatgacaacacagacacagtacgacctcgtacccgctaacggatccgaatttgagttgagcgtaacgcaggtacccgatgaacagcatatccgcttctggccgcagcactttggcaccatcccgcagtggataacgctggaaccgcgcattttcgcctggatggaccgcttctgtgatgagtactgcgggggtatctggtccttttacacgctcagcaatggcggagcgtttatggctcctgatgctgacggtgacgataaatggcatttgctcaacggcatgaatggcaatggtgcggaaatgagcgcggaagccgcaggtatcgctgtctgcctgattgaatatagccatcacgcctgcctcaccgaatgcgatgccatgacggagcactattaccgcctgcgggattacgctctgcagcaccctgaatccagcgccattatgcgcattattgattaaggatactcatgatggaacagtcactcatcccacagacaccggtacttccactgaccgcacaacgcacggtaaaacgcgccttaacgctgcttgaccgacacctgcgcgaaacaggcgtggcattcacctccactcaggctgctcgtgactggctgaagctgaaaatggcggggctggagcgtgaagaatttatgatgctgtatctgaaccagcagaaccagttgattgcccacgaaaccctgtttgccggttctattagcagtaccgaggtacatccccgtgaggtggtcaaacgcgccctgtatttcaatgcagcagcagtgatactggcgcataaccacccctccggcgacactactcccagccaggcagataagactataacgcagcgtctggtgcaggcgcttcagctcgttgatatccgtgtccctgaccatctgattgttggtggcaggcaaatctattcgttcgcagaacacggtctgctttgaggtattacatgagaattatcagtaaacgccgggcaatgacgatataccgccagcatcctgagtcccgaatctttcgctactgcaccggaaaatatcagtggcacggtagcgtctgtcattacaccggcagggatgttccggatatcacaggagtcctggctgtgtacgccgaacgccgcaggaccgcagcggaccgtatgcttgactgatgagtatcaccctgaactgacaataaagaggttatgaatgagcaacaccacatggggcctgcagcgagatatcacgccgcgcctgggagcacgtctggtgcaggagggcaaccagctgcactatctggctgaccgggccagtatcaccggtaagtttagtgacgccgaatgtcctaagctggatgtggtatttccacattttatcagccagatagagtcgatgctgaccactggtgaactgaatccccgccatgcccaatgcgtcaccctgtaccacaacggttttacctgcgaagccgatactcttggtagttgcggctacgtatacatcgctgtttaccccactcaacgctaactaatttcacgagagcaagcatgaacactctacctgctacaatttcgcaggcggcgaagccctgcctgtcgccagtggctgtctggcaaatgctactgacacgcctgctggaacaacactatggcctgacactgaacgacacgccgttcagtgatgaaactgttattaaggaacatatcgatgctggtatcactctggccgatgcagtcaattttctggtggaaaagtacgaactggtacgtatcgatcacagaggattttcgtggcaacaacagtctccatatatttccgtagtagatattctgcgagcaaggcgctctaccggcttgctaaaaactaatgtgaaataaacgcttaaatacagagcagactgaaggaaagcaaaatgctaatctcatagacgaagagactcccgctgtaacctcccctcccccgaaaaaacctgacattttcttttaggaccaacaatgggaccaaaatgaaaattgaactgaagattacaatcaatttaacaacaagttacacaaccaattcagactccgccagcccaccaatcatgattggacggtgtaaggacaacaccaacaaaaacaggaagttagaagtctcagcaaaacaccgaccagacggtgaggagacataaaaggatacgcaaaggagccgcggctcctggtaacatgaaagcccacagatgtgggctttttcgttgatggtcagaacgaccagttcacaccagctaccgcgttccacggggattccacaccggcactatggctataccccaccccaagatgcccgcttaacgtactgctgaatgaggctttaatacctgcctggtatattccacgtctgcccgacaaataattgacgaaattaccgtcactattcactttcacccggttatcatcgacaaattctttgcgcacagccgccttcagccacggctcaacttccataccgttccccagacgcatgttgtaactcagcgttgcgcccagttcacgatatatactgcgggtatcgactgatttcgatttcatgccattggataaatgatattcggggttatcagcggtgaaccccgttaacgatgcatacggcgtcaggttccagttaccatcggtaaatcgcatcccggtttcaatgtgaccgcccagcccgttgctgtggtaactgccattggcggctccaccgctgctcattttacctgctacgttacttttaaaacggttcagcttcacgacaccgtccagatagaaaccactttcatgttcccaactggcatagccgcccagagaataactgcccacactgccatgtcctccgcgatcaaaaccgatatgtgaatgggaatagcccataaaagcgcctagcgtggtaattccttcaggaatatcattacggctgtcgatccccactgtcattccggtcagcgtctgctcaaacccggcacccgcatcggtggtgacattattacgggtgttatacgtcgccccccagacattattgttgtgtggactcgctttcattatgttcaaccgctcgcgaatactgtttagctcagcatcaaataccaacggtaatgttgctgccatattgagtacggctgccgtagaaggcgtaatgcgtttctccggaacgggtgtcggcgttggatcgggagtagggtctggttttggatttgggtctggctttggatcgggttttgggtctggctttggatttgggatggggtccgggttgggtttgacatcattggtcaggttccagttgctgttgccgtcacttttcaggacatactcataggtcccaagatcaacgaaaccgccggtattgcccagcgtaaacgaagcatcccctccccctgttttcaccagcgtcatcgcgtcgtcagactgtgggctgacgccggtatcctgaacaaagattttaaaattaccagtggcgttgttgttgacgaccagttgatcgccccgggagcctgcaacgttggtatgcaggtagaaattaccgctaccggaaagttcattggttgtcagcgtattgtagataccgttagttgtggcaggcgctgctgtttgtgctgacaaataaacatcaccgtcgttgagtagcaaactgtttactctatattcgcagttgctggtacctgcacaggaattattgctgttaagccagacactgccccggctggcagccgtcaggtcggcaagcgtggtatcgacgccatttcccagagtcaatgtcgcgctatcggtaatccggaccgccccttcgagtttaactggcgtaacattatcccgtggcgtcattaacgacaggcttcctgtcgcgccactgaccgatgcatccgccagcgtacctgcgtagacgattgccgtaccgccagcgacctggagatcttctgcccgggccagagcctgaaactcatcttttgaccgcccaagggtatattgcccgccagagttaacctttgtggcggagtcctgacccaggttttgcattgccccacccttgccaaccgtggagtcgcgagcttcggtacctgctaataccaataaattaccgccattttccagcaacatattggtcgctaaattgccggaaatggaaaaagtaccgtactggtgagtaccgctgatttcaataccgttagccgtgctcgtctggagagcggcaccgctgttctggacgatatctgtcgctttgccattatcgttgactgtcagcgtaccgccttcattgatctttgtttttattgcctctccgttagctgaaactgtttgtattccgccgtcgttaattgttgtctcattcgccacaccctcgacaatttgttcaccgccggtgagcgtcgtgcctgtcgcagtggcttttgttttgacgatctcccgtccgcccatattgacctgtgttttgtcagaagaggtgtctgactccacggttaacacgccgccatttgccagcaggatattgttcgccgcaccctgctcgatgctgaacgcgacgccatccgcgcgtgttcctgtgacccgcgtcgccctggtggttgcaaccaaagcgccctggctactctgctgtatccccgttgcgctgcctttctcccgcacatcgagtgtgccgccgtcattaagcaccgagttttcagccaggccgccctcattaactacctgtgaacccccattaataatggaaccttccgctgtcccgtttgccataatttgttgtaggccagagacgatatcggtattgattgccttaccataattctgaacggtttgcgtgccaccattgatgtgtgttttctctgttgacccaccatcaacaatttgttcaccactttcgatatttgcttcagtggctaaaccatataccgtttgcttgccacctttgatatttgctttatcagaagtggcactggcatatattgtttgggtgccagcactattgagtacagtgccaacatcttttccataaacatccattttgccgttggcattaataatcgtgtcaactgcgcgggaaccagtgacgactgttaatgagccagcgttttccagcactacatttttagcttctgaattcctgatgtagaaagcatcaccataactgttggttccttcgataagtgttccggaggtcgtggaagcaattaatgcgccgccggattgttgctcaacatgcttagcctcaccaccgtcctgaacctccagaacgccgccattattaagtctggtgctatctgttttagcctccttctggacaatcagcttaccgccagtatcaatggtagtatttttcgccgaggttttagccactaccgtcagttcgccggtattttccagcacaacataattagcctcccctccggtaatagtgaagtgagagagcttgttgtatccttcgatatcagtccctgcacccgtgttggcaactaaagcactgcccgtctcctggttaaccccatgtgcaataccgccggtatagacaatcagcgagcctccggcgctaatattgctgccaattgccgtaccatctttctcaacaacctgccggctcccggaggatataattgttgtgtcagctttcccgccgcttttgatattttgcgttccgctgttgatattggtgcctgtggctatgccataattattaatattctgtgtgccaccattaattatggtatttgtcgcgtttcctgcaacatccataaccccgccattatctattcgggtcgcatcagctttagcattggttaaaactgacattgttcctttatctttaataatcgtcttgtttgccgaaccatatgcgtttatgtctaaatgaccaccgttttccagcaacacattgtctgccacgtgattgtggatggagaatgcaccttcactattcgtaccgctcaccgtcgtaccgttagtgttagtttttaaaattgcaccatcgtgctgggtaacatttgttgccgtaccacccctaacatcaagcacgccaccagaataaacttcaataacatccgaggtgctggtgttatcaacaatttgcgtgccaccagaatagatatgcgtattttttgccgttgacttactattcagagactgagttccgccttcaatcgtcgtgtccagcgcacggctctcatatactctttgctcaccgccatttttaatggttgttgtttctactgtgctctgttcaacatactgtcgaccaccatttatggttgtgttcgttgccagacttccttgtactacgtcctgagagccagacttatttatcgttgtaccatcagcatgcccttgaacttttactatctggctaccaccatcaatgagtattccattcgcactccctccctctacgcgtgaagcaccgcccttaattgtcgttccattgctgataccccctttataaacgtcctgattgccactctcgattgtcgtacctgtggaaatacccccgtcatgaattgactgtctgccaccgttaatggttgtattattagcctgccccacaaaattgttatgacttcctatatcttgatatccaccagattcaataagacttccattagataccccgccatgaacattctgctggccatggttgataatatgagtgttatttgttgtacctcgttcatccactttttggttgccatctacagtctcatcgtttaccacaccaataacattagtagtgaaggcagccatcccgggcggggcatatatcaaggcagatatcaataaggaaagtactgagcggcgacaataatagggactggtcctgttcataaatttcatcctctgaaaagtgaatactgagtagcgtttaagcgaccttagctttgctgcaacatcagcccacaggcaccagaccaggggattcatcctgaagagacagcgcaagtgtattgtgttcaccgctcatcaaagacatcatgatgaaatgatgatattccgcataagaatgaggcattttttaaacgcagtgcgctgaagtgtggttggataaaaaagtcaatccattcaggaaatacgggcgtattcttttctttcgacaatgaggccgttggcaaaataaaatgatttacataatcgtttctgatgaatatcttctgctcacataaaaatcacacaataactttgagatcgcagattgttttacttttacagcattcgtccccccattgttgggcaaatatagattgggccagagcacgaaagttaataccacgttcgcacagctcctccaacagcacgacaagatgccacatactgcgccccagtcggttcagtttacagactagcagtgcgttccctgccgatgatgtcctgaccagttttttcagtccggacctcctgccacggttttacgttgaagtggtaaccctgagcacgcagttcttcagtcaggcgtggtgcaccgtaacgctgttattgctgggtaagatcaaaaaactttcaggcagctaaggaaagttgaaccagacattagatgaaatatttcaaccaattacagcaccaattcagtcactgccagcccaccaaataaatcaaggggttacatgaaaacgtagcccctttttctttggtagtgacactaaaatggatgtagtgtgaagaataatcccgtttactcaatcaataatacatattgtttcaatctacgttattatctctttgtaaaaattgccatttattaatcattgaaaactgcttttagaacttgatacaacgggactagtcacaacaggactattctcaacgggatcatcctcagaggaactatcatcaaagtcatcatccataaataaaatatcatcgaatggtgccacgcccgtgatgagttttattttattattacgatcagtcaatactccacttaaaccgttttcgctcacaggttttaatgatttttcattactcttgttgtaagcaggcgcattaaaaatacacggagtatcaacatcaaacaatgacgttccccagttcacatattgaatatcatagttactgaagttctgtccagaaaagaagcaccccttaaaatccaatccacgtaaattatataaaccaccctcttctttttggagagtaatgttaattttggctatctcccggacatcatcgccatttttgtatttgaataccgtttcaagatgttctccagacagcttgacttcaggaaataatttgaaatcaaagcctatattattatgtgtcaacgtagatgaacaaaaaatggaaaaagcttgcagtgctgaattatagctatcgattttatcttgaggctgagctcttggtaaaaacttatagcaacactcataaaaattaaacagaagctctgaagaccttgtatttttatcaaataatacccccttgaactcattcacaaacgcatcttttttttcttgaatatctatggggtgttcctttgactctgacaaagatgaaatctcatctattttgttttcatatgaattacgtgattccatacagacatttggcggcgtttctaaaataacactacgcgtactacttggcttaagtaaaccaacatgaaaatcactttttcttatattatcgaaaaggttctattcatttcttttagcgcattcaaaaaactgatcggcattatttttattcgataattttttagtttcagaaaacacattttcattgttttccagctttagtttaatgagaagattttcccagacctgcttgcttaaacatattacgtcaggctcaccagaactaactaactcgtgattattattaaagtgtacgttgaatacctttaagttattttcaccaacttcatatttaatacgttttaattgttctccagctcccataatgacaaaggcgttgccttcttgatatatacattcagacatcattttttgtaaagtttcaagagcaccgcgatacgtctctgatgcagcttccttacaaattaattttaaaatactatgagctagtagctccatgtgtttagaagatttattttcattataacttccactacccaaaactgcgctagcgttaaatccgttgcttttactaactaacattgtctattcctcaattaatgtctacatggctatttttaatgttattactgtttgtcactataaaaaaacgctcatttgagacaattactgacattaactgcttcacttgctacgcatggaacttttaattaaattagcacaggaatgttaaatttaataaacaaaaggttatttcgctgtatgataaaaaaaaccgttataatttattagtgaaaatcgtttttcaagtgttagaaatttatatctcaatagcgttggttaatgagcatagccacgctcctgtaacgctcacaaaactcatctgcctgcggcgggtgttctggtcagtagtagatgtttaaggcgtggcagagacatttcatccttactctacggcattgttctacatacattggttgtggtactcacttatcatcagtgagcgaacagagaatagttcagtgatttgagtaattaacctgattaaatgaaggggtataataaatgataatactctggctttatcgttaattacttaattccacatgtaagcaatttgcccgcttggcatagcaggcattttttccaggtacttttgaatgagtactgatggataaatacattgcagtggcgtgccacgtaccaaaacaccagccctcattcgaaaccacccaccgcacttcttccttgaaatggcgttagtcatgaaatatagaccgccatcgagtaccccttgtacccttaactcttcctgatacgtaaataatgatttggtggcccttgctggacttgaaccagcgaccaagcgattatgagtcgcctgctctaaccactgagctaaagggccttgagtgtgcaataacaatacttataaaccacgcaataaacatgatgatcatatgatgtaaataacagatttttatgcgttcccattcaccttgggtcgtgattacacgcgacataaaacccgacaccgcctccattcgcaaagtcgatactcgcagtcaacaagcaaatgttaataattagcactatctatagttatcatcgattcaatgatactttgtaatgattttgtatctaataatataactttattacattagctgaagagttttcgcatcattatgatatctgttacttttcactccataaaaataaacttcgtatagcaatatattctttcatagatcttattctgctaatcattagtttcgtatgagcgatttttgacagttgcctctccagaccacatcgataattaataaaacagatttaagcattatccttttccatataaatattggataaaagtaggacatctgtttgcaattactttcacaacaattaaacatttttatgtttccgtatacatcatattactctaccattagaggaactttattatgttttctataaaaccaggacccagaaatttacctatcgacaaccccacattgttatcatggaacattactgacggggatctaaattccaaattaaatacattagaatatctaaactgtataacaaatattattaattcttgtggagtttaccctcaaggattaaaagacagagaaattatatcaacttttcacgcagaaaaagttattaatgatctgttaaaaaacgattataaaatttccctttctccagatacaacttaccgagagttgaataaagcagcacagcgtagcattacagcgccagacaggataggagaaagaaaaacataggtttatcaacgagatacaatgattgaaagaggtgataacagcggtgtttatcagtatggtcgtgctgaacatttcacccacattatatctgacaaaccttccccaaaagataaatatgttgcatatgctattaacattcctgactatgagctggcagccgatgtatataatattaacgtgacgtcaccttccggacagcaagaaacatttaaaatattaatcaatctagaacatctacggcaaacacttgaacgtaaatctcttactgctgttcagaaatcacaatgtgaaatcatcacccccaaaaaacctggcgaagcgattcttcatgcttttaatgccacctaccagcagatcagagaaaatatgtctgaatttgcacgttgccattatgggtatatacaaatccctccagtgacaactttccgcgccgacggaccagaaactcccgaagaagaaaagggttactggtttcatgcttatcaacccgaagatctttgtaccatccataatccaatgggagatttgcaggattttattgcattggttaaagatgctaaaaaatttggtatcgatatcattcctgattatacctttaactttatgggaattgggggtagtggtaaaaatgacctggattatccctctgctgatatacgagcgaagatcagtaaagatatagaaggtggtatccctggctattagcaaggtcaggttttgattccattcattaaagatccagtaacaaaagaacgtaaacaaatccatccagaagatatacatctcactgcaaaagacttcgaagcaagtaaagataacatctctaaggatgaatgggaaaacctccatgcattaaaagaaaagcgtttaaatggaatgcctaaaacaacacccaaaagtgaccaggttattatgttgcaaaatcaatacgttcgtgaaatgcgaaaatatggcgtacgaggtttacgttatgatgcggcaaaacactcaaaacatgaacaaatagaaagatcaataaccccaccgcttaaaaattataatgagcggttacacaatactaacttatttaacccaaaatatcataaaaaagccgttatgaattacatggaatatctggtaacttgtcagttggatgaacaacaaatgtcatcactgctttatgaaagagatgatttaagcgccattgatttttcattgctcatgaaaacgataaaagccttttcatttggtggagatcttcaaacccttgcatcaaaaccgggttccacaatctcaagtatcccatcagaaagacggatattgattaacattaaccacgattttcctaacaatggtaatcttttcaatgactttctatttaaccatcaacaagatgaacaattagcaatggcatatatagccgctctgccgttcagcaggcctttagtttactgggatggccaagtattaaaatcaacgactgaaattaaaaattatgatgggtccacgcgtgtcggcggtgaggcgtagcttaataaaggttgctctacctatcagcagctctacaatgaattccacgcattatatatagataaagcaggaatatggagcgcatttgagggtgtatctgcaactaaaaacgttctggcctttagtcgtggggattctgtgaacattaatcactctcctcatgatggactagttataataaataaaggaaacgaagaagttgaaggtacctggcctaacaaattgcaacctggaatatacaaaaacatggggagtaatagcgttaacattattattaataatacccgaaaaattatcccccctggtaaagtatttacgcttagaggcggaactctaaatatcaatattcctgggcgtagcgctcttcttttagggaaaacaggagaaccgccgaactatctctatttataatttaatgttatatctgccccgataaaacggggcagataatatgtttagtttactaacggtcattttgcagtgaagccatttactgttttttatcgaccagataatctgttctctaatgttaactccccctaacctgttgctttagttattcatttcctgtctcactttgccttaataccctacgttaaatgttactaatttgttgcttttgatcacaataagaaaacaatatgtcgcttttgtgcgcatttttcagaaatgtagatatttttagattatggctacgaaatgagcatcgccatgtcaccctacatctcataagaggatcgcttctgatgaatgcactgaccgccgtacaaaataacgctgtcgattcaggccaggactatagcggattcaccctcaccccgtcggcgcaatccccgcgtctgctggaactcaccttcaccgaacagacgaccaaacagtttcttgagcaggttgccgagtggcccgtgcaggcgctggagtacaaatcgtttctgcgttttcgggtagccaaaattcttgacgatctatgtgcgaaccagctgcaaccattgctgttgaagacgttgctaaaccgcgctgaaggtgcgttgttgatcaatgcggtgggtgtcgatgatgtgaagcaagcggatgagatggtgaagctggcgacggcggtggcgcatctgattggccgttccaatttcgatgcgatgagcggtcagtattacgcgcgttttgtagtgaaaaatgtcgataactcagacagctatctgcgccagccgcaccgcgtgatggagctacacaacgacggcacgtatgtcgaagagataaccgattacgtgctgatgatgaaaatcgacgagcaaaacatgcagggcggaaattcgctgctgctgcatctcgatgactgggaacatctcgacaactatttccgccacccgctggcgcgtcgcccgatgcgctttgccgcgccgccgagtaaaaacgtcagcaaagatgtttttcatccggtgttcgacgtcgatcaacagggtcgcccggtgatgcgctatatcgaccagttcgtccagccgaaagacttcgaagaaggcgtgtggttgagcgagctttccgacgccattgaaaccagcaaaggcattctttctgtgcccgttcccgttggcaaattcctgttgattaacaacctgttctggctgcacggtcgcgaccgctttactccgcacccggatctgcgccgtgaactgatgcgccagcgtggctatttcgcttacgcctctaaccactaccagacgcatcagtaagcgcaaaggaattgagcggatgtatgattttgtgattattggcggcggcatcatcggcatgtcgaccgccatgcaactgattgatgtctatccggacgcccgcattgcgttgctggaaaaagagtccgccccggcctgtcaccagacgggccacaacagcggcgtgatccatgccggggtctattacacgcccggcagcctgaaggcgcagttttgcctggcgggaaaccgcgccaccaaagccttttgcgatcaaaacggcattcgctacgacaactgcggcaagatgctggttgccacgtccgatctcgaaatggaacggatgcgcgccttatgggaacgcacagcggcgaacggtatcgagcgcgaatggcttaacgccgacgaactgcgcgagcgcgaaccgaatatcaccgggctcggcggcatttttgtgccgtccagcggcattgtcagctaccgcgacgtgacggcggcgatggcaaaaatcttccagtccagaggcggtgaaattatctataacgccgaagtcagcgggcttaatgagcataaaaacggcgtggtgatacgtacccgtcagggcggcgaatatgaagcatcaacgctgattagctgttccgggctgatggctgaccggctggtgaaaatgctcggactcgaaccgggctttatcatctgcccgttccgtggcgagtatttccgccttgcgccggagcataaccagattgttaaccacctgatttaccccattcccgacccggcaatgccgtttttgggcgttcatctcacccgcatgatcgacggcagcgtgaccgtcgggccaaacgcggtgctggctttcaaacgcgaaggctatcgcaagcgcgacttctcatttagcgacacgctggagattttgggctcgtcggggattcgccgggtgctgcaaaaccatctacgctcaggactgggcgagatgaaaaactcgctgtgcaaaagcggctatctgcggctggtgcaaaagtattgtccccggctttcgttaagcgatctccagccctggcccgccggtgtgcgggcgcaggcggtatcgccggacggcaagctgattgacgattttctgtttgtcaccaccccgcgcacgatccacacctgcaatgcgccctccccggcagcgacatcagcaattcctattggtgcgcatattgtcagcaaggtacaaacgctgttggcaagccagagtaaccccggacgcacgctgcgagcggcacgtagtgtggatgccttacacgccgcatttaatcaataacctttgaaaacaggatgtagcgatgaaacttaacgacagtaacttattccgccagcaggcgttgattaacggggaatggctggacgccaacaatggtgaagccatcgacgtcaccaatccggcgaacggcgacaagctgggtagcgtgccgaaaatgggcgcggatgaaacccgcgccgctatcgacgccgccaaccgcgccctgcccgcctggcgcgcgctcaccgccaaagaacgcgccaccattctgcgcaactggttcaatttgatgatggagcatcaggacgatttagcgcgcctgatgaccctcgaacagggtaaaccactggccgaagcgaaaggcgaaatcagctacgccgcctcctttattgagtggtttgccgaagaaggcaaacgcatttatggcgacaccattcctggtcatcaggccgataaacgcctgattgttatcaagcagccgattggcgtcaccgcggctatcacgccgtggaacttcccggcggcgatgattacccgcaaagccggtccggcgctggcagcaggctgcaccatggtgctgaagcccgccagtcagacgccgttctctgcgctggcgctggcggagctggcgatccgcgcgggcgttccggctggggtatttaacgtggtcaccggttcggcgggcgcggtcggtaacgaactgaccagtaacccgctggtgcgcaaactgtcgtttaccggttcgaccgaaattggccgccagttaatggaacagtgcgcgaaagacatcaagaaagtgtcgctggagctgggcggtaacgcgccgtttatcgtctttgacgatgccgacctcgacaaagccgtggaaggcgcgctggcctcgaaattccgcaacgccgggcaaacctgcgtctgcgccaaccgcctgtatgtgcaggacggcgtgtatgaccgttttgccgaaaaattgcagcaggcagtgagcaaactgcacatcggcgacgggctggataacggcgtcaccatcgggccgctgatcgatgaaaaagcggtagcaaaagtggaagagcatattgccgatgcgctggagaaaggcgcgcgcgtggtttgcggcggtaaagcgcacgaacgcggcggcaacttcttccagccgaccattctggtggacgttccggccaacgccaaagtgtcgaaagaagagacgttcggccccctcgccccgctgttccgctttaaagatgaagctgatgtgattgcgcaagccaatgacaccgagtttggccttgccgcctatttctacgcccgtgatttaagccgcgtcttccgcgtgggcgaagcgctggagtacggcatcgtcggcatcaataccggcattatttccaatgaagtggccccgttcggcggcatcaaagcctcgggtctgggtcgtgaaggttcgaagtatggcatcgaagattacttagaaatcaaatatatgtgcatcggtctttaactggagaatgcgaatgaacagcaataaagagttaatgcagcgccgcagtcaggcgattccccgtggcgttgggcaaattcacccgattttcgctgaccgcgcggaaaactgccgggtgtgggacgttgaaggccgtgagtatcttgatttcgcgggcgggattgcggtgctcaataccgggcacctgcatccgaaggtggtggccgcggtggaagcgcagttgaaaaaactgtcgcacacctgcttccaggtgctggcttacgagccgtatctggagctgtgcgagattatgaatcagaaggtgccgggcgatttcgccaagaaaacgctgctggttacgaccggttccgaagcggtggaaaacgcggtaaaaatcgcccgcgccgccaccaaacgtagcggcaccatcgcttttagcggcgcgtatcacgggcgcacgcattacacgctggcgctgaccggcaaggtgaatccgtactctgcgggcatggggctgatgccgggtcatgtttatcgcgcgctttatccttgcccgctgcacggcataagcgaggatgacgctatcgccagcatccaccggatcttcaaaaatgatgccgcgccggaagatatcgccgccatcgtgattgagccggttcagggcgaaggcggtttctacgcctcgtcgccagcctttatgcagcgtttacgcgctctgtgtgacgagcacgggatcatgctgattgccgatgaagtgcagagcggcgcggggcgtaccggcacgctgtttgcgatggagcagatgggcgttgcgccggatcttaccacctttgcgaaatcgatcgcgggcggcttcccgctggcgggcgtcaccgggcgcgcggaagtaatggatgccgtcgctccaggcggtctgggcggcacctatgcgggtaacccgattgcctgcgtggctgcgctggaagtgttgaaggtgtttgagcaggaaaatctgctgcaaaaagccaacgatctggggcagaagttgaaagacggattgctggcgatagccgaaaaacacccggagatcggcgacgtacgcgggctgggggcgatgatcgccattgagctgtttgaagacggcgatcacaacaagccggacgccaaactcaccgccgagatcgtggctcgcgcccgcgataaaggcctgattcttctctcctgcggcccgtattacaacgtgctgcgcatccttgtaccgctcaccattgaagacgctcagatccgtcagggtctggagatcatcagccagtgttttgatgaggcgaagcagtagcgccgctcctatgccggaggcgacgctgcgcgtcttgtccggcctacggggatccaggtcggataaggcgtttacgccgcatccgacaatctgtacgtgaacaggaagaaatctatgttggccgggtaaggcggagccgctctccggcaaaaagaatcaataacaattatacgcgtgacccggcgcgggaaatgtcggggcgctctcccaagtgacacactttcgagaggattcaggatggggcaatcatcgcaaccacatgagttaggcggcgggctgaagtcacgccacgtcaccatgttgtctattgccggtgttatcggcgcaagtctgtttgtcggttccagcgtcgccatcgccgaagcgggcccggcggtattactggcctatctgttcgccgggctactggtggttatgattatgcggatgttggcggaaatggcggttgccacgcccgataccggttcgttttccacctatgccgataaagccattggtcgctgggcgggctataccatcggctggttgtactggtggttttgggtactggttatcccgctggaagccaacatcgccgccatgatcctgcactcatgggttccaggcattcccatctggttattttccctcgtcattaccctcgccttaactggcagtaacttattaagcgttaaaaactacggcgaatttgagttctggctggcgctgtgcaaagtcatcgctatcctggcctttattttccttggtgcagtcgcaattagcggtttttacccgtatgccgaagtgagcgggatctcaagattgtgggatagcggcggctttatgcccaacggtttcggtgcggtattaagcgcgatgttgatcaccatgttctcgtttatgggcgcagaaattgtcaccattgccgccgcggaatccgacacgccggaaaaacatattgtccgcgccaccaactcggttatctggcgtatttctatcttctatttatgttctatttttgtcgtcgtggcattaattccgtggaatatgcccggactaaaagccgtcggttcttatcgctcggtactggaattgctcaatattccccatgcgaaattaatcatggactgcgtgatattactttccgtaaccagttgcctgaactcggcgctgtataccgcgtcaaggatgctctactccttaagtcgtcgcggtgatgctcccgcggtaatgggtaaaatcaaccgcagtaaaaccccgtacgtggcggtgttactctccaccggcgcggcattcttaacggtggtggtgaactattacgcgcctgcgaaggtatttaaatttctgatcgacagctccggcgctatcgccctgctggtttatttagtcatcgccgtttcacagttgcggatgcgcaaaattctgcgagcagaaggaagcgaaattcgcttgcgaatgtggctttatccgtggctcacctggctagtcatcggctttattacctttgtgttggtagtgatgctattccgtccggcgcaacagttagaagtgatctccaccggcttattagcgatagggattatctgtaccgtgccaattatggctcgctggaaaaagctggtattgtggcaaaaaacacccgttcataatacgcgctgatcatgatcaggagtcacaccatgaccattacgtctctggatggctatcgctggctgaagaacgatattattcgcggtaattttcaaccggatgaaaaattacgaatgagtttgctgacatcgcgttatgcacttggcgttgggccgttacgggaagctctttcgcaactggtggcggaacggctggtcacggtggtgaatcaaaaagggtatcgggtggcgtctatgtcagagcaggagctgctcgatattttcgacgcccgcgccaatatggaagcgatgttagtgagtctggcgattgcccgcggtggcgatgagtgggaggcagacgttctcgcaaaagcgcatctgctgagtaagcttgaggcctgtgacgccagcgagaaaatgcttgatgagtgggatctgcgtcatcaggcgtttcatacggcaattgtggcgggctgtggttctcactatttgctgcaaatgcgtgaacggttgtttgatctggcggcgcgttatcgatttatctggctgcggcgaacggtgctttcggtggaaatgctggaggataaacacgatcagcaccagaccctgactgcggcggtactggcgcgagataccgcgcgcgccagtgagttaatgcgccagcatttactgacgccaattcccattatccagcaggcgatggctggcaattaactactcttccggaatacgcaacacttgccccggataaattttatccgggctttttagcatcggtttattcgcttcgaagattttattgtacagattagcgttaccgtagacctgtttggaaatggcactcagagtgtcgccagacttaacggtataaaactggctggcagtggctggtgtcgccgttttcacctgatcatcgacactggcaataccggaaatattccccaccgcaacaaggattttctccttcgcctcctgactcaggccgtcaccagtgaccgtcgctttgccgtcggcaatttgaatattcactttatcggcatccggtataccggttttgttcagatgctcctgcaccttcttcgcctgatcgtctttatcgtgctgacctgtaaccgcgtcccagagtttttctccggcatctttcacaaaattgaacagacccatagctacctcattcgttaacggaaacactcagaaagtgtagcagaggaacgcggcgcgttaacgccgcggggatgagcacaggtttaatcgcgggtttgcacccagaacgcgtgaatcaaaccggggatatacccaagcagtgtcaacagaatattaataatgaacgcccaaccgaaccctttaccgagcagcacgccgagcggcggcagaatgatggtgatgacgattctccagaaacccatatgtactccctataagaaaattactcattgtttaaaaagagattttatctcttaagcgtagtaattttagcggagcctgccagtttcagcttacgcttttactctcatttacgctgctgaggctggtatatgttgcatttttagtttagagtttacttaatttagaaaatacttaaataaatatgactgaactcgcgcaattacaggccagtgccgaacaggcagcggccttattgaaagcaatgagccaccctaaacgattgctgattctgtgcatgcttagcggttcccccggcaccagcgcgggagagctgacgcgcattaccggactgagtgcctctgcgacatcacagcatctcgctcgtatgcgggacgaagggcttatcgacagccaacgggatgcccaacgcattctatattccattaaaaatgaggcggtaaatgccattatcgccaccctgaaaaatgtctattgtccgtaaggagtcactatggctttgacaaccatttcgccgcatgatgcacaagaattaatcgcacgcggcgcaaagttaatcgatattcgtgatgctgatgaatatcttcgtgaacatattcctgaagcagatctggctccattatccgtgctggaacagtcaggtcttccggctaaattacgtcacgagcaaattatattccactgccaggcaggtaaacgcaccagtaataatgccgataaattagcagcgattgccgcccccgcagaaatctttttactcgaagatgggattgatggctggaaaaaagcaggattgccagtagcggtaaataaatctcaacccttgccgttaatgcgccaggtgcagatcgctgcgggtggtttaatattaatcggcgttgtactgggttataccgtaaatagcggtttcttcttattaagtggctttgttggtgccgggttactgtttgcaggaatcagcggtttttgtggaatggcaaggttgttagataagatgccgtggaaccaacgagcttgagaagcgacgccggacgcgccctagcagcgacatccggcctcagtaattagatcaggaaatcgtcgagagatttaccttctgccagcgcctgagcaattggcttcggtgtacggccctgaccggtccaggttttagtttcaccgttaacatcggtgaatttatatttcgccggacgcggctggcgttttttaccagcgcgtggtgcagcagcagagctattacccaataactcttccgggttaattccgtcagctttcatcagctccagccaggtgctaattttttcctggcgctctgccagttcacgctgctgctgttcttcttcttcacgtctttctttagtgacaaccctgaatttttcgagcatttcttcaagaacgtcaatggagaattcgcgagccatcgcacggagggtgcgaatgttatttaaactttgtaacattacggacataataaagaaaaccttttaacgccaaaacaaaaaaagtatttcgtcgcgtagtgtaagcgatcacttattatatttccacaaaatttaatctatttacagtcctgcgcgagattatttcagctgttattttctgaaactctcagaataatttcaagattatatattagccattttgatgagtaatttagattattggtgaacagagcggcgctctctgctcgctaattccgcaagcctgacaaaatcaaagtgaataaaaatgcaatataacagaataaaagaaaacatccatcactggtgctttctgctgttaatgtacattgtctggcataaaaaatgctgaaaatgacccagctactacatacaccgaattctctacgcttatagcgttacctcacccccaaactttcattagtgatattaaaggtaaggccatatctaattgatttaattaaaaataaatcatatcggcatgtaaaaatccacaatgtacaaaaaacgagccgttacggaatattttatctacaaaaactgactaaataaaaatttttcactaattgattagtcatagccagcgatatacgctatgcgaaaatgcagatggcaatgagatccactgctttcatctccattaacatcccattacgcttttattaaggagcattagcatgttctcaccgcagtcacgcttgcgtcatgcagttgcagatacgttcgcgatggttgtttactgttctgtcgtgaacatgtgtattgaagttttcctctccggaatgagcttcgaacagtctttttattccagattggtagcgattccggtgaacatcttaattgcatggccatacggtatgtaccgtgatctgtttatgcgcgcggcacgcaaagttagcccgtcgggctggataaaaaatctggcggatatcctggcttatgtgacgttccagtcaccggtgtatgtggcgatcttgttagtggtgggcgcagactggcatcagattatggcggcggtcagttcaaacatcgttgtttcgatgttgatgggggcggtttatggctacttcctcgattattgccgccgactgtttaaagtcagccgttaccagcaggtaaaagcctgactcttcttttcgcgactggcatcgccagtcgcgtctttaactggcttcgccaaataaaccattcaaataacgttcaagcgcaacacgcgaactaaagccatgcgggataccgtaatgctcgtgtcgctcgcctgctaaatagagcggaaattgctggtaatgatcgcaagttttaatatcggaagcgggttcagccagtgtcgaactgcgttcttttaatgttggatgaattaccagagcggtacgtcccattcgcgcttcgcgattaacatagacataattttccccacggcggtaaccatacgctttctgggttaccacatcgacagtaaaaccgactttttcaagtacgcgcgccacctcgtctggtcgtaaatacatatttgatcctcgttattatcaaccgcgggcctaccttacctgattgcgcattcacaacgctttcagaaaagtccataaagccgcgatgaacctcagttaagaaaattatggtctacactgaaaattacatcgaattctaatgggggatcatatgtttaaccgaccgaaccgcaacgacgttgatgatggcgtgcaggatatccagaatgatgtcaatcaattagctgacagcctcgaatctgtattgaagtcctggggcagcgacgccaaaggggaagctgaagccgcacgcagtaaagctcaggcattgctgaaagaaaccagggcgcgaatgcatggtcgtactcgcgtccagcaagccgcgcgcgatgccgttggctgcgcggattcttttgttcgtgaaagaccctggtgtagcgtgggtacagcagctgcggtaggtatttttatcggcgcactgttaagcatgcgcaaatcgtagtgcaaaaatgataataaatacgcgtctttgaccccgaagcctgtcttcggggtttctttttgcctggtgaatcacaaaaatccccctaccccgtcacgctcatatccagggtaatttcgaccactatttgctatatattgtgtggttgaatcttttttcaactacatctagtatctctgtatcaacagagagacaacccgacgcgtatcatcgcgccgtatcttcattttaaacggaaatacgaatcatgcgcattactatttacactcgtaacgattgcgttcagtgccacgccaccaaacgggcgatggaaaaccggggctttgattttgaaatgattaatgtcgatcgcgttcctgaagcggcagaagcgttgcgtgctcagggctttcgtcagttgccggtagtgattgctggcgatcttagctggtctggtttccgtccggacatgattaaccgtctgcatccagcgccacacgcggccagtgcatgagccagctcgtctacttctccagcagctccgaaaacacgcagcgttttatcgaacgtttaggtctgcccgcggtgcgcatcccgctcaatgagcgggaacggattcaggtagacgagccttacatcctgatcgtgccctcttacggcggcggcggtacggctggcgcggtgccacgacaggtaattcgctttttaaacgacgagcacaaccgggcgttgcttcgcggcgttattgcttctggtaatcgcaactttggtgaggcgtatggccgcgccggagatgtgattgcccggaaatgcggcgtgccgtggctgtaccgttttgaactcatgggtacgcaaagcgatatcgaaaacgttcgtaaaggagtaaccgaattttggcaacgacaaccgcagaatgcctgacgcaggaaacgatggattaccacgcgctgaatgcgatgcttaacctctacgatagcgcaggtcgcattcagttcgataaagaccgccaggccgttgacgcctttattgcgacgcatgtgcgtccgaacagtgtgaccttcagtagccagcagcagcgcctgaactggctggtcaacgaaggttactatgatgaaagcgttcttaatcgctactctcgcgactttgtcattacgctgtttacccacgcacacaccagcggttttcgtttccagacattcctcggggcatggaagttttacaccagctatacgttgaagacattcgacggtaaacgttatctggaagattttgccgatcgagtaacgatggtggcgctgacgctggcacaaggcgatgagacgctggcgttgcaactgaccgatgaaatgctgtcaggacgctttcagccagccacgccaacattcctcaactgcggtaagcagcagcgcggcgaactggtttcctgttttttgctgcgtattgaagacaatatggagtcgattggtcgggcggtaaattccgcactgcagctgtcgaaacgcggcggcggcgtagcatttttgctgtcgaatctgcgagaagcgggcgcgccaattaaacgtattgaaaatcaatcttctggcgtaattccggtgatgaaaatgctggaagacgcattttcctatgccaaccaactcggcgctcgtcagggggctggtgcagtctatttacatgctcatcatcccgatattctgcgttttctcgacacgaaacgggaaaatgccgacgaaaaaatccgcattaaaacactgtcgcttggcgtggtgatcccggatatcactttccatctggcaaaagagaatgcgcagatggcgctgttttcgccttatgacgtagagcgagtttatggcaagccgtttgccgatgtggccatcagccaacactatgacgaactggttgccgatgaacgcattcgcaaaaaatacctcaacgcccgtgatttcttccagcgactggcagaaatccagtttgagtccggctatccctacatcatgtatgaagacacggtaaaccgtgctaaccctatcgccgggcgcataaatatgagtaatctctgctcagaaattttgcaggttaacagcgcctcagagtatgacgagaatctcgactatacccgcacaggccatgatatttcctgcaatttaggttcgttgaatattgcgcacaccatggattcccccgattttgcccgcacggtagagactgccgtgcgcggtttaacggcagtatcagatatgagtcatatccgcagcgtgccgtccatcgaagccggaaatgccgcctcgcacgccatcggactggggcagatgaatttacacggctatctggcgcgagaaggcatcgcttatggttcgccggaagcactggatttcaccaatctctatttctatgccatcacctggcatgcactgcgtacctcgatgttgctggcacgcgaacgcggtgaaaccttcgccgggttcaaacagtcacgctatgccagtggtgaatattttagccaatatctgcaagggaactggcagccgaaaacggcgaaagttggcgaactgtttacccgtagcggtattacgttacctacccgtgagatgtgggcgcagctgcgcgacgacgtgatgcgctacggcatatacaaccagaatcttcaggcggtgccgccaaccggttctatctcttatatcaaccatgctacgtcgagtattcatccgattgtggcgaaagtagagatacgcaaagagggcaaaacaggacgcgtttactaccctgccccgtttatgactaacgagaatctggcgctgtatcaggacgcttacgaaattggcgcagaaaagatcatcgacacctacgcggaagcgactcgccatgtcgatcaggggctgtcgctgacgctttttttccccgataccgccaccactcgcgatatcaacaaagcgcagatttacgcctggcgcaagggtatcaaaacgctctattacatccgcctgcgtcagatggcgctggaaggcactgaaattgaaggctgcgtctcctgtgcactttaaggaatatctatgaaactctcacgtatcagcgccatcaactggaacaagatatctgacgataaagatctggaggtgtggaatcgcctgaccagcaatttctggctaccagaaaaggtgccgctgtcgaacgatattcctgcctggcagacattaactgtcgtagaacaacaactgacgatgcgcgtttttactggcctgacgctgctcgacacgctgcaaaatgttatcggcgcgccttctctgatgcccgatgcactcacgcctcatgaagaagcggtattatcgaatatcagctttatggaagcggttcatgcccgctcttacagttcgattttctcgacgctatgccagaccaaagatgtcgatgccgcctacgcctggagtgaagaaaacgcaccgttgcagcgaaaagctcagattattcagcaacattatcgcggtgatgatccgctgaaaaagaaaatcgccagtgtgtttcttgaatcttttttgttctattccggtttctggctgccgatgtatttttccagccgcggaaagctgaccaataccgcggacctgatccgtctgattatccgcgatgaagcagtccacggttactacataggctataaatatcagaaaaacatggaaaagatatctctgggacaacgtgaagagttgaagagtttcgccttcgatttgttgctggaactctacgacaacgagttgcaatacaccgatgagctgtacgccgaaaccccgtgggctgacgatgtgaaagcgtttctctgttacaacgccaataaggctttgatgaatctgggctacgaaccgttatttcccgcagaaatggcggaagtgaatccggcaatcctcgccgcgctttcgccgaatgccgatgaaaatcacgatttcttttccggttcaggctcctcttatgtgatggggaaagcggttgaaacagaagatgaagactggaatttctgagggtgttattttcaaaaatatcactacccgcagcagggaaataattcccgccaaatagctttttatcacgcaaataatttgtggtgatctacactgatactctgttgcattattcgcctgaaaccacaatattcaggcgttttttcgctatctttgacaaaaaatatcaactttctcgatttgctctcagcccttatatcacgggaaattccggcgatttgctcgcatcaatattcatgccacatttgccatcaggggttgcctcagattctcagtatgttagggtagaaaaaagtgactatttccattgggtaatatatcgacatagacaaataaaggaatctttctattgcatggcaattaaattagaaattaaaaatctttataaaatatttggcgagcatccacagcgagcgttcaaatatatcgaacaaggactttcaaaagaacaaattctggaaaaaactgggctatcgcttggcgtaaaagacgccagtctggccattgaagaaggcgagatatttgtcatcatgggattatccggctcgggtaaatccacaatggtacgccttctcaatcgcctgattgaacccacccgcgggcaagtgctgattgatggtgtggatattgccaaaatatccgacgccgaactccgtgaggtgcgcagaaaaaagattgcgatggtcttccagtcctttgccttaatgccgcatatgaccgtgctggacaatactgcgttcggtatggaattggccggaattaatgccgaagaacgccgggaaaaagcccttgatgcactgcgtcaggtcgggctggaaaattatgcccacagctacccggatgaactctctggcgggatgcgtcaacgtgtgggattagcccgcgcgttagcgattaatccggatatattattaatggacgaagccttctcggcgctcgatccattaattcgcaccgagatgcaggatgagctggtaaaattacaggcgaaacatcagcgcaccattgtctttatttcccacgatcttgatgaagccatgcgtattggcgaccgaattgccattatgcaaaatggtgaagtggtacaggtcggcacaccggatgaaattctcaataatccggcgaatgattatgtccgtaccttcttccgtggcgttgatattagtcaggtattcagtgcgaaagatattgcccgccggacaccgaatggcttaattcgtaaaacccctggcttcggcccacgttcggcactgaaattattgcaggatgaagatcgcgaatatggctacgttatcgaacgcggtaataagtttgtcggcgcagtctccatcgattcgcttaaaaccgcgttaacgcagcagcaaggtcttgatgcggcgctgattgatgcgccgttagcagtcgatgcacaaacgcctcttagcgagttgctctctcatgtcggacaggcaccctgtgcggtgcccgtggtcgacgaggaccaacagtatgtcggcatcatttcgaaaggaatgctgctgcgcgctttagatcgtgagggggtaaataatggctgatcaaaataatccgtgggataccacgccagcggcggacagtgccgcgcaatccgcagacgcctggggtacaccgacgactgcaccgactgacggcggtggtgctgactggctgaccagtacgcctgcgccaaacgtcgagcattttaatattctcgatccgttccataaaacgctgatcccgctcgacagttgggtcactgaagggatcgactgggtcgttacccatttccgtcccgtcttccagggcgtgcgcgttccggttgattatatcctcaacggtttccagcaattgctgctgggtatgcccgcaccggtggcgattatcgttttcgctctcatcgcctggcagatttccggggtcggaatgggtgtggcgacgctggtttcgctgattgccatcggcgcaatcggtgcctggtcgcaggcaatggtgactctggcgctggtgttaaccgccctgctgttctgtatcgtcatcggtttgccgttggggatatggctggcgagaagtccgcgagcggcgaaaattattcgtccactgcttgatgccatgcagaccacgccagcgtttgtttatctggtgccaatcgtcatgctatttggtatcggtaacgtgccgggcgtggtggtgacgatcatctttgctctgccgccgattatccgtctgaccattctggggattaaccaggttccggcggatctgattgaagcctcgcgctcattcggtgccagcccgcgccagatgctgttcaaagttcagttaccgctggcgatgccgaccattatggcgggcgttaaccagacgctgatgctggccctttctatggtggtcatcgcctcgatgattgccgtcggcgggttgggtcagatggtacttcgcggtatcggtcgtctggatatggggcttgccaccgttggcggcgtcgggattgtgatcctcgccattatcctcgatcgtctgacgcaggccgttgggcgcgactcacgcagtcgcggcaaccgtcgctggtacaccactggccctgttggtctgctgacccgcccattcattaagtaactctgcacttgcccggtgacgccgggcattatcaccctgccaaaaaaaggaataacaatgcgacatagcgtactttttgcgacagcgtttgccacgcttatctctacacaaacttttgctgccgatctgccgggcaaaggcattactgttaatccagttcagagcaccatcactgaagaaaccttccagacgctgctggtcagtcgtgcgctggagaaattaggttataccgtcaacaaacccagcgaagtagattacaacgttggctacacctcgcttgcttccggcgatgcaaccttcaccgccgtgaactggacgccactgcatgacaacatgtacgaagctgccggtggcgataagaaattttatcgtgaaggggtatttgttaacggcgcggcacagggttacctgatcgataagaaaaccgccgaccagtacaaaatcaccaacatcgcacaactgaaagatccgaagatcgccaaactgttcgataccaacggcgacggaaaagcggatttaaccggttgtaaccctggctggggctgcgaaggtgcgatcaaccaccagcttgccgcgtatgaactgaccaacaccgtgacgcataatcaggggaactacgcagcgatgatggccgacaccatcagtcgctacaaagagggcaaaccggtgttttattacacctggacgccgtactgggtgagtaacgaactgaagccgggcaaagatgtcgtctggttgcaggtgccgttctccgcactgccgggcgataaaaacgccgataccaaactgccgaatggtgcgaattatggcttcccggtcagcaccatgcatatcgttgccaacaaagcctgggccgagaaaaacccggcagcagcgaaactgtttgccattatgcagttgccagtggcagatattaacgcccagaacgccattatgcatgacggcaaagcctcagaaggcgatattcagggacacgttgatggttggatcaaagcccaccagcagcagttcgatggctgggtgaatgaggcgctggcagcgcagaagtaatttttattcgggcggataaggcgtttttgccgcatccgccgttctgtgcacaatgcctgatgcgacgctggcgcgtcttatcatgcctacaaaccacatcgcacatttcaacaatctatctttcatcccatattcatcaacatccgctattattgatttccagcttaatcatcacctgatgaacaaaaataatgactaaacctaatcatgagcttagcccggcgctgatcgtgctgatgtctatcgccaccggtctggcggtagccagtaactattacgcccagccattgctcgacaccatcgcgcgtaacttttccctttccgccagttcggcaggctttattgttaccgccgcgcagttgggctatgccgcaggtctactgtttcttgttcccctcggtgatatgtttgaacgccgccgcctgattgtctcgatgaccttactggcggcatgttgattaccgccagcagtcagtcgctggcgatgatgatcctcggtacggcattaaccggtttattctcagtcgtggcacaaattctggttccgctggcagcgacgctggcttcaccggataaacgcggcaaagtggttggcactattatgagcggtctgctgttggggatcttgctggcacggacagttgccggattgctggcgaatctcggcggctggcgcaccgtcttttgggttgcttcggtgttaatggcactgatggcgctggcattatggcgtggtctgccacaaatgaaatcagaaacccacctcaactacccacagttgttgggttccgttttcagtatgtttatcagcgataaaattctgcgtacccgcgcgttgctgggctgcctgacctttgccaatttcagcattctctggacctcaatggcctttttgcttgccgctccaccttttaactacagcgatggtgtcattggtctgtttggacttgcgggagctgccggagcgttgggcgctcgtccggcgggcggttttgccgataagggcaaatcgcaccacaccacaactttcggtctgctgctgctattactttcatggctggcgatctggtttggtcacacttccgtactggcgttgattatcggaatcctggtgctggatctcaccgtgcagggcgtgcatatcactaaccagacggtaatttatcggatacatcctgatgcgcgcaatcgcctgaccgcaggttacatgactagctactttattggcggtgccgccggttcgctaatttcagcctcagcctggcaacatggcggttgggctggcgtttgtctggctggcgcgacgattgccctggttaacttactggtctggtggcgaggttttcatcgtcaggaagccgcaaattaagcaatcagcaaccgttttcgtggctttacacttataagggtgttaagaagcccatcagtctgataaggttaagatattcattcagtctatttataatattaacaatcgttaagcgtacactctatggaaagccctactccacagcctgctcctggttcggcgaccttcatggaaggatgcaaagacagtttaccgattgttattagttatattccggtggcctttgcgttcggtctgaatgcgacccgtctgggattctctcctctcgaaagcgtttttttctcctgcatcatttatgcaggcgcgagccagttcgtcattaccgcgatgctggcagccgggagtagtttgtggattgctgcactgaccgtcatggcaatggatgttcgccatgtgttgtatggcccgtcactgcgtagccgtattattcagcgtctgcaaaaatcgaaaaccgccctgtgggcgtttggcctgacggatgaggtttttgccgccgcaaccgcaaaactggtacgcaataatcgccgctggagcgagaactggatgatcggcattgccttcagttcatggtcatcgtgggtatttggtacggtaataggggcattctccggcagcggcttgctgcaaggttatcccgccgttgaagctgcattaggttttatgcttccggcactctttatgagtttcctgctcgcctctttccagcgcaaacaatctctttgcgttaccgcagcgttagttggtgcccttgcaggcgtaacgctattttctattcccgtcgccattctggcaggcattgtctgtggctgcctcactgcgttaatccaggcattctggcaaggagcgcccgatgagctatgaggttctgctgcttgggttactagttggcgtggcgaattattgcttccgctatttgccgctgcgcctgcgtgtgggtaatgcccgcccaaccaaacgtggcgcggtaggtattttgctcgacaccattggcatcgcctcgatatgcgctctgctggttgtctctaccgcaccagaagtgatgcacgatacacgccgtttcgtgcccacgctggtcggcttcgcggtactgggtgccagtttctataaaacacgcagcattatcatcccaacactgcttagtgcgctggcctatgggctcgcctggaaagtgatggcgattatataacccacaagaatcatttttctaaaacaatacatttactttatttgtcactgtcgttactatatcggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcaggggattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaacgcgtcatctcgctcaaaaatccagatttataaaagaaaaaatgactggccagcatcgcaacatgctggcctttttggcaagcaggtcggctcagccgatgagttaagaagatcgtggagaacaatatgagcgcaaatgcggagactcaaaccccgcagcaaccggtaaagaagagcggcaaacgtaagcgtctgctcctccttctcaccttgctctttataattattgccgtagcgatagggatttattggtttttggtactgcgtcacttcgaagaaaccgatgacgcatacgtggcagggaatcaaattcaaattatgtctcaggtgtctggcagcgtgacgaaagtctgggccgataacaccgattttgtaaaagaaggcgacgtgctggtcactctcgacccgacagatgctcgccaggcgtttgaaaaagccaaaactgcactggcttccagcgttcgccaaacccaccagctgatgattaacagcaagcagttgcaggcgaatattgaggtgcagaaaatcgccctcgcgaaagcacaaagcgactacaaccgccgtgtgccgctgggcaatgccaacctgattggtcgcgaagagctgcaacacgcccgcgacgccgtcaccagtgcccaggcgcaactggacgtcgcgattcaacaatacaatgccaatcaggcgatgattctggggactaaactggaagatcagccagccgtgcaacaggctgccaccgaagtacgtaacgcctggctggcgctggagcgtactcgtattatcagtccgatgaccggttatgtctcccgccgcgcggtacagcctggggcgcaaattagcccaacgacgccgctgatggcggtcgttccagccaccaatatgtgggtggatgccaactttaaagagacgcagattgccaatatgcgtatcggtcagccggtcactatcaccacggatatttacggcgatgatgtgaaatacaccggtaaagtggttggtctggatatgggcacaggtagcgcgttctcactgcttccagcgcaaaatgcgaccggtaactggatcaaagtcgttcagcgtctgcctgtgcgtatcgaactggaccagaaacagctggagcaatatccgctgcgtatcggtttgtccacgctggtgagcgtcaataccactaaccgtgacggtcaggtactggcaaataaagtacgttccactccggtagcggtaagcaccgcgcgtgaaatcagcctggcacctgtcaataaactgatcgacgatatcgtaaaagctaacgctggctaatccagaggtgcgtgtgatgcaacagcaaaaaccgctggaaggcgcgcaactggtcattatgacgattgcgctgtcactggcgacattcatgcaggtgctggactccaccattgctaacgtggcgatccccactatcgccgggaatctgggctcatcgctcagccagggaacgtgggtaatcacttctttcggggtggcgaatgccatctcgatcccgcttaccggctggctggcaaagcgcgtcggggaagtgaaactgttcctttggtccaccatcgcctttgctattgcgtcgtgggcgtgtggtgtctccagcagcctgaatatgctgatcttcttccgcgtgattcaggggattgtcgccgggccgttgatcccgctttcgcaaagtctattgctgaataactacccgccagccaaacgctcgatcgcgctggcgttgtggtcgatgacggtgattgtcgcgccaatttgcggcccgatcctcggcggttatatcagcgataattaccactggggctggatattcttcatcaacgtgccgattggcgtggcggtggtgttgatgacactgcaaactctgcgcggacgtgaaacccgcaccgaacggcggcggattgatgccgtggggctggcactgctggttattggtatcggcagcctgcagattatgctcgaccgcggtaaagagctggactggttttcatcacaggaaattatcatccttaccgtggtggcggtggtggctatctgcttcctgattgtctgggagctgaccgacgataacccgatagtcgatctgtcgttgtttaagtcgcgcaacttcaccatcggctgcttgtgtatcagcctcgcgtatatgctctacttcggcgctattgttctgctgccgcagttgttgcaggaggtctacggttacacggcgacctgggcaggtttggcctctgcgccggtagggattattccggtgatcctgtcgccgattatcggccgcttcgcgcataaactggatatgcggcggctggtaaccttcagctttattatgtatgccgtctgcttctactggcgtgcctatacctttgaaccaggtatggattttggcgcgtcggcctggccgcagtttatccaggggtttgcggtggcctgcttctttatgccgctgaccaccattacgctgtctggtttgccaccggaacgactggcggcggcatcgagcctctctaactttacgcgaacgctggcggggtctatcggcacgtcgataaccacgaccatgtggaccaaccgcgagtcgatgcaccatgcgcagttgactgagtcggtaaacccgttcaacccgaatgcccaggcgatgtacagtcaactggaagggcttgggatgacgcaacagcaggcatcaggctggattgcccagcagatcaccaatcaggggctgattatttccgccaatgagatcttctggatgtcagccgggatattcctcgtcctgctggggctggtgtggtttgctaaaccgccatttggcgcaggtggcggcggaggcggtgcgcactaagtacaactaagccagttcatttgaactggcttttttcaattaattgtgaagatagtttactgactagatgtgcagttcctgcaacttctctttcggcagtgccagttcttcgttgctgttgatgcgtacgtcacgttccagaatgctacgcgcaatatcctgcgcttcctgcaacgagtgcatctggtaagtgccacactggtagacgttcagttccgggatctgattctgatcctgcactttcagcacgtcttccattgccgctttccaggcatcagcaacacgctgctcatctggcgtaccaatcagactcatataaaaaccggtgcggcagcccattggcgagatatcgataatctctacaccattaccgttaagatggttacgcataaaaccagcaaacaggtgctccagggtatggatccctctttctggcatcacttctttgttcggcacgcagaagcgcagatcgaacacggtgattgcgtcgccatgcggggtgttcattgttttcgccacccgaactgcaggcgcttccatccgggtatgatcgactgtgaagctatctaacaacggcatttagccacctccggtaatttttttaaaaattttctgaactctttcttcccaggcgagtctgagtatatgaaagacgcgcatttgttatcatcatccctgaattcagagatgaaattttggccactcacgagtggcctttttcttttctgtcaggcgtgtttttccagccacaccgcaaacggttcggtatcagcggcttccatttcctgctgacggcgttcagacgcctcgcgctcggctacaaaatcctcttcgcgcagaatttccagcggctcttcacgcagcagattacggtaggcttctgcaaatgctttgcctgttccgccaataccagtatcaatcatagaccttaagatacgggcagagaaagtcagatcgggattatcgaagcaggcaaccagttcatcacacactttctgatacgcttcgccgccgttaatactatccagcgtttgcgcgacgcgtttcagatcgcggaacagatctttacccacctgcggtaacgggaactgtgcggtttcgcagccgatacccagcgtcagacccggtttgcgaccttcgaggatcacccggttccagttaacgcgtgtacaggcaagttcgctactgctcatttccggtgcatcagccagcgcacaccagaccataaacaggtcgaggaatcgcacctgctgttcatctacaccaatcggcgagaacgggttgatgtccagcgaacgcacttcaatatattcaatgccgccacgtaacagcgcatcagaaggcgactcgccgctgcgggtaacgcgttttggacgaatcggcgcgtacagttcgttttcaatctgcaacacgttgctgttgatttgcagcctcttaccgtctttctcaataccaatcttcgcgtactcttccgatggcgttttgattgcctgtttaaggcccgctacgtactcgtaaagatcgttgaaggtaataccaagattgctttgcgatttattggtatagccgagatcgctcaaacgaagagaggtcgcatacggcaggtaatacataccgcactcggttttctcaaacggcagcgacgttggttttccttgcaggaaagaagaacaaatcgccggagatgcaccaaacagataaggaatgacccaaccgaaacgatagtaattgcggataacgcggaaatagcccgcagaaattttctctttggcatcagcgcccgagatatcaccgcacttcgcttgccagaatgccattggcaaagagaaattgtagtgcacgccggaaatggtttgcatcagcgcgccgtagcgatttttcagcccttcacgatacagcgttttaaagcgtccggtgttagaagtgccgtactgtgccagttcgatgtcctgaccttctgcgatgtagcatggcatacttaacggccacatccgctcatcgcccatattgcgcgccgtataacgatgcagatcgcgcataaaggtcagcatatgttcaatatcaccatccactggtgtaatgaattccagcaatgcttccgcaaaatcggtagtaatccatttgtgcgtcagtgcggaacctaatgcttcaggatgacctgttgttgccagtgtgccatcagcattaacacgcaaagtttcgcgctccagcccacgctgtatcccctttaacgcctgaggatgtttttccagccaggccagcgcctgtgatacgtccgggatcaaattgacctcccgcctgtcaaaatcgttttaattagcataactgtaatggtgaccatatgtgcaggcctacaattagtgccaccacatcatgccctgaacggtcgctgctgcaactgcaacatagcgtaacgctttaccaaggcacaaaaaaaagattaccggtccccacgagatgcgcatccatcccgctaacagacacagtaaatcgccaaccacgggcatccagcttaataatagcgtgactgcaccatagcgtttcagccagccggtagctttctcttgccagcgcgatgttttacgcaatggaaagaaacgcccaaggataacgttagttaaccctccaaggctattacccattgttgctgttaaaactaaaacccagggatgactgatcccggaaagcaacattgccaccagcacgacttcggagttgccgggtaatagtgtagcgctgagaaaactactggcaaacaacgagaaaagcgataacgcttcactcacagcaagcgaacatccacggcgtccatgcctgctgcacgggccgcctgaataccgaaatcggcatcttcaaagaccacacactgcgtcggttgcacgcccatacgctgcgcgcacaacaaaaatgtgtctggcgcgggtttatggtgtttgacgtgatcggcagcgacgacggcgtcaaaataatggcgtaatcccaggtgcgccagcaatgcctcagcgatggcgctttcactccccgttcctacagccattgggcgacgaccatgccaacttttcaccacatcaacaagaggaagcggttcgacgctatccagcagcatacttcttactgcttctgttttttcacgcgctaacgcatgcgggtcgagatcggcctgattcagctcaataattgcctgagcaatacgccaggtgggcgatccattaagcgcaatcatcgcctgaatatcgtactgaagaccgtagtgccctaatacttcgcgccacgctttacggtgcgtaggctccgtatccaggattgtgccatccatatcaaaaattaaacctgcataacgctcgtacatggtcttctcgcaagtcgaaaaatatgacgctactttagcgtaattgcttgattttgtcgctgatggcgaaggagaagaaaattcaggaaatggataaaggagttatttagaaatgagatatttttgaaggaaattttttggagaagatggtgcatccgggaggatgactcactgacgttcgcccttcgggccgttgctggcgcaacgttatccttcctggtgcctgcggttaataccgctatctcttcgataccttcattgctgaaggttacggagaatatggtgcatccgggaggattcgaacctccgaccgctcggttcgtagccgagtactctatccagctgagctacggatgcatcgggaaaacttattctactgctgatattgataccgctactaaagccatatcaattaagagatggtgcatccgggaggattactcgccttgcggctcgcccttcgggccgttgctaaagcaacgttatcatccctagtgcctgcggttaattccgctacctcttcgataccttcattgctgaagatttcggagaatatggtgcatccgggaggattcgaacctccgaccgctcggttcgtagccgagtactctatccagctgagctacggatgcatcgggaaatttattttactgctgatattgataccgctactaaagccatatcaagtaagagatggtgcatccgggaggattcgaacctccgaccgctcggttcgtagccgagtactctatccagctgagctacggatgcatcgggaaacttactttactgcagattttttgataccgctactaaagccgtatcaagtaagagatggtgcatccgggaggattactcgccttgcggctcgcccttcgggccgttgctaaagcaacgttatcctccctggtgcctgcggttattaccgccacctcttccataccttcatcgctgaaagtacgtagaatatggtgcatccgggaggattcgaacctccgaccgctcggttcgtagccgagtactctatccagctgagctacggatgcaaatggcggtgaggcggggattcgaaccccggatgcagcttttgaccgcatactcccttagcaggggagcgccttcagcctctcggccacctcaccacacgcctcttacgagtgcttcgaagaacttgtttatcgctcatcgtcgctgcgtggcgcacatattactttctgagacttataagtcaaacaatttttcctacacttttatcgtttgcacacttcacgttcaattagtctgtaaaaacgtcaaaaagagtgttttatcaacagaagaatggaggtctgacagatagtagtaatgcaaaaaaatggagacttaagttgaatgaacgggagtaaagcgaaaagactatagagtgaaggagaaattttgagggtgcgtctcaccgataaagatgagacgcggaaagattagtaactggactgctgggatttttcagcctggatacgctggtagatctcttcacggtgaacagaaacttccttcggggcatttacgccaatacgtacctggttgccctttacccctaaaactgtcacggtgacctcatccccaatcatgagggtctcaccaactcgacgagtcagaatcagcattctttgctccttgaaagattaaaagagtcgggtctctctgtatcccggcattatccatcatataacgccaaaaagtaagcaatgacaaacacattacatctaagcagtcatggcattacattctgttaaacctaagtttagccgatatacacaacttcaacctgactttatcgttgtcgatagcgttaatgcgaatgccgtgaagcgagtccacggcattgcctgacgcttatattattgcaatttcgcgctgacccagcctttcacactggctaacgctgcaggtaaggccgcagcatccgtaccaccggcttgcgccatgtcaggacgtccaccacccttgccgcccacctgctgagcgaccataccaatcagttcccctgctttcacacgatctgtgacgtccttagatacgcctgcaatcagagaaaccttaccttcgactaccgttgccagcacgataattgtcgaccccagctgattttttaaatcgtcaaccatggtacgcaacattttcggctcaacaccgctaagctcgctaaccaacagcttaacaccattaacatcaattgccttactggaaagatttgcgctctcctgtgcggcagcttgttctttaagctgttgtaactctttttccagctgacgcgtacgttccagtactgagcgcactttatcagccagattattgctatcgcctttcagcagatgcgcgacttcgcttaagcgatcgctgtctgcatgaacggtggcgatagcaccttctccggttaccgcttcgatacgacgaacgcctgcagcagtacccgattcagagatgatgcggaacagaccaatatcaccagtgcggctggcgtgagtaccgccacacaactcggtagagaaatcgcccatgctcagcacgcgtacgcgctcatcatacttctcgccgaacagcgccatcgcacctttcgctttcgccgcttcgagatccatgatgttggtttcgatcggcaaattgcgacgaatctgtgtgttcaccaggtcttcgaccgcacgaatctcttctggtttcatcgcttcgttgtgtgagaagtcgaagcgcagcaccttgtcgttaaccagtgaacctttctgcgatacatgagtacccagaacctggcgcagcgcagcgtgcatcaggtgcgttgcggagtgattcagacgaatacgggcgcgacgagcctcatcaacatcagcctgcaccgcgtcgcccactttcagagaacccgcagcaagtttaccgatgtgaccaatcgcctggccgtatttctgcgtatcttccaccgcaaaggagaagttagcgcctttcagttcgcctttatcgccaacctgaccgccggattccgcatagaatggcgtttgatccagcacgaccacagcttcctggcctgcattgatggcatcaaccgctttaccatcaacaaacagcgcagtcactttgccgttcagttccagatggtcatagcctttaaattcagatgcactgtcaacacggatcattgcgttgtaatcggcaccaaagccgctggcttcgcgcgcgcgacgacgctgctcttccattgcagcttcaaaaccagcttcgtcaactttgatgttgcgctcacgacaaacatcagccgtcaggtcaaccgggaagccataggtgtcgtacagacggaaagcagtttcaccatccagcgtatcaccagaaagttttgccagctcttcatccagcaacgccagaccgcgctccagagtacgagcaaactgctcttcttcagtcttcagcacctgctcaacctgcgcctgctggcgtttcaggtcttcacccgcagagcccataacgtcgatcagcggaccaaccagtttgtagaagaaggtttctttcgcgccgagcatattaccgtgacgcactgcgcgacgaatgatacgacgcagtacataaccacggttttcattggacggcattacgccatccgcgatcaggaacgcacaagaacgaatgtggtcagcgattacgcgcagcgatttattgctcagatcggttgcgccagtgactttcgctaccgcctggatcagcgtgcggaacaggtcgatgtcatagttagagttaacgtgttgcagcaccgcagcaatacgctccagacccataccggtatctacagacggcttcggcagcggttccatcgtgccatcggcctggcggttgaactgcatgaagacgatgttccagatctcaatgtagcggtcgccgtcttcttccgggcttcccggagggcccccccaaatgtggtcgccgtgatcgtagaagatttcggtgcacgggccgcacggaccagtgtcacccatctgccagaagttgtcagatgcgtatggcgcacctttgttatcgccgatgcgaataatacgttcgcgcgggatccctacttctttttcccagatttcgtaggcttcgtcgtcgctttcatagacggtaacccacagacgctctttcggcagggcaaaccatttttcgctggtcagcagttcccatgcaaactgaatggcatcgtgtttgaaatagtcgccgaagctgaagttgcccagcatttcgaagaaggtatggtgacgcgcggtgtaaccgacgttttccaggtcgttgtgtttaccacccgcacgcacgcagcgttgggaagtggtagcgcgggaataattacgcttgtcgagcccaaggaacacatccttgaactggttcatcccggcgttggtaaacaacaaagttgggtcgttatggggtaccagggagctgctggcaactacctgatgtcccttactatggaaaaagtcgagaaacgcctgacggatctcagcggtgctcttgctcataattatcctgaaatcaagctaacgaaatatcgccaccagctccagcgtgtcttaaccgccgggctggtaactgaaaagtgggaataagataagttttcttgactgggaagtaaaataccgtatgcgttcagtcggcaaaatttcgccaaatctcctggatatcttccatcagatagccacgatagagcagaaaacgctggatcttaactttttctgaaaagacagttggcaaaggttcgccatattttcgcgtcgcctgatcgcgcgccagtgcgcaccagtcgatgtcacattcacgcatcgctttttctgtcgcttcgcgggaaatacctttctgattcagttcctggcgaatacgcgcaggtccataacctttgcggctacggctggcgataaagcgcgcaacaaatcggctgtcatcgagatagccatgttcatggcaccaggcaataacgcgctcgtaatcttctgccgtagcatcaatctcttctgggccatttttgcccataatcggtgccgcgagtttacgtcgcagttcttgctcactgtgatcgcgcaccgccagaatgcgtaccgcacgatccaacaggcgagcatatgccgggcgacgggatgttgattctgtcatggcatatccttacaacttaaaaaagcaaaagggccgcagatgcgacccttgtgtatcaaacaagacgattaaaaatcttcgttagtttctgctacgccttcgctatcatctacagagaaatccggcgttgagttcgggttgctcagcagcaactcacgtactttcttctcgatctctttcgcggtttccgggttatctttcagccaggcagtcgcattcgctttaccctgaccgatcttctcacctttgtagctgtaccacgcgcctgctttctcgatcagcttctcttttacgcccaggtcaaccagttcgccgtagaagttgataccttcgccgtagaggatctggaattcagcctgtttaaacggcgcagcgattttgttcttcaccactttcacgcgggtttcgctacccaccacgttttcgccctctttcaccgcgccgatacgacggatgtcgagacgaacagaggcgtagaatttcagcgcgttaccaccggtagtggtttccgggttaccgaacatcacaccaattttcatacggatctggttgatgaagatcagcagcgtgttggactgcttcaggttacccgccagcttacgcatcgcctggctcatcatacgtgccgcaaggcccatgtgagagtcgccgatttcgccttcgatttccgctttcggcgtcagtgccgccacggagtcaacgacgataacgtctactgcgccagaacgcgccagggcgtcacagatttccagtgcctgctcgccggtgtccggctgggagcacagcaggttgtcgatatcgacgcccagtttacgtgcgtagattgggtccagcgcgtgttcagcatcgataaacgcacaggttttaccttcacgctgcgctgcggcgatcacctgcagcgtcagcgtggttttaccggaagattccggtccgtagatttcgacgatacggcccatcggcagaccacctgccccaagcgcgatatccagtgaaagcgaaccggtagagatggtttccacatccatggaacggtcttcacccaggcgcatgatggagcctttaccaaattgtttctcaatctggcccagtgctgccgccaacgctttctgtttgttttcgtcgatagccatttttactcctgtcatgccgggtaataccggatagtcaatatgttctgttgaagcaattatactgtatgctcatacagtatcaagtgttttgtagaaattgttgccacaaggtctgcaatgcatacgcagtagcctgacgacgcaccgcatcacggtcgccgctgaagcattcccgccgggtaatgccttcaccgcgggcagtggcaaaagcaaaccagacggtgccgacaggcttctcttcactgccgccatccggcccggcgataccactaatagacacggcataatcagcacgagccgctttcagtgcgcctatcgccatttccaccacgacgggttcactcaccgcgccatgctgcgccagcgtctcttcgcgtacgccgatcatctgcgctttggcttcgttactgtaggtgacaaatccgcgttcaaaccaggcggagctaccggcaatatcggtaatcactttcgctacccaaccaccggtacaagactcggcagttgttacggttgcgccacgggctttcagcgcctgcccaacctgttcacttaactgcatcagttcactgtcagtcatcacaacctctgtcagtcaaaaatttatgccggacaagatagcactttcgtcaggaagatggtgttggcgttgcaattttacgaggaggattcagaaaaaagctgattagccagagggaagctcacgcccccctcttgtaaatagctactgtactcgcgccagcgccacggcttgtcctaactgccagaccgccattgcgtaatgggtgctgtggttgtaacgggtgatggtgtagaagttcggcagaccgtaccagtactggtagccggtgccaacatccagacgcagcaggctggcttgttgatggttgcccagcggctgctgtggcgttaaacctgcggcggcaagctgcgaaatgctgtacttagttttgaagccatttggcaagcctggagcctgaccgtttgccattaccgcgacctgatcgcctttcacccagccgtgcgctttgaaatagttcgccacgctaccgatcgcatcaaccggatcccacaggttgatatgcccgtcgccgctgaaatctaccgcatattgtttgtaagacgacggcataaactgtccgtagcccatcgccccggcaaaggaacctttcagattgagcggatcgtcctgctcgtcgcgcgccatcaacaggaaggtttccagctcgccagagaaatactccgcgcggcgtgggtagttaaatgacagcgttgccagcgcatcgaggatgcgagttttccccatcacgcgcccccagcgggtttcaacgccgataatcccgacgataatttccggcggtactccatacacctgccacgcgcgattcaacgcatcttcatactgattccagaaaaccacaccgttctgcacgttgtccggcgtaataaattttttgcgataacggagccatgcgccgttcggacctgatggcggtttcaccgatgtggttggtgcctggttatccatcagccgcagtaccgaatccagacgcttcgcctgggagagaatttcctgcaactgctgacgatcgaaaccgtgtttgttcaccattttgtcgatgaactgctgggcattcgggttattagcgaaatcgccgcccatctgcatcacattgtgctgcggctcaagcaggaagccgccagacggcgttccggtggtcgtatcagtctcagtaggttttggcttgctgctacaggcggcaagcaacacaaaaaggggaagcaatgttacataacgacgcttgaacatgaggggtccatttaacagattcaaccaggggcaagtatggtaaagcatcacgccccgcacaaggaagcggtagtcactgcccgatacggactttacataactcaactcattcccctcgctatccttttattcaaactttcaaattaaaatatttatctttcattttgcgatcaaaataacacttttaaatctttcaatctgattagattaggttgccgtttggtaataaaacaataaatcctgaaggagagaacaatgatagaaaccattactcatggtgcagagtggtttatcgggctgttccaaaagggcggagaggtgtttaccgggatggtgaccggcattcttccgctgttgattagcctgctggttatcatgaacgcactgattaattttatcggtcagcatcgtattgaacgttttgctcaacgttgcgccggtaaccctgtttcccgttacctactgttaccgtgcattggcacgtttgtcttttgcaatccgatgaccctaagcctgggtcgctttatgccggaaaagtacaaacccagctactacgcggcggcctcttatagctgccactcaatgaatggcctcttcccccatatcaaccctggcgaactgtttgtttatcttggcattgccagcggtctgacaacgctgaacctgccacttggcccactggcggtgagttatctgctggttggtctggtcaccaatttcttccgcggctgggtgaccgatctgaccaccgccatttttgagaaaaagatgggcattcaacttgaacaaaaagttcacctggcaggagcaacatcatgacgcatattcggatcgaaaaaggaacgggtggctggggcggcccgcttgagctgaaagccacgccgggaaaaaaaatcgtctatatcaccgccggtacccggcctgcgattgttgacaaactggcacagcttactggctggcaggctattgacggatttaaagaaggtgaacccgcggaggcggaaattggtgtcgcggtaatcgactgtggcggcacattacgctgcggcatctatccgaaacgacgtattcccaccattaatatccactcgacgggcaagtccggtccgctggcgcagtacattgtggaagatatttatgtctctggcgtaaaagaagaaaacatcactgtagtaggtgatgcgacaccacaaccctcttccgtgggccgtgactatgacaccagtaagaaaatcaccgaacaaagcgatggtttactggcgaaggtgggaatgggcatggggtccaccgttgcggtgctgtttcaatctggtcgtgacaccatcgacactgtattaaaaaccattctgccgtttatggcattcgtctcggcgctcattggcatcattatggcttctggccttggtgactggattgcccacggtcttgctccgctggcgagccatccactgggtctggtcatgctggcgctcatctgttccttcccactgctttcacctttcctcggcccaggcgcagttatcgcacaggttatcggcgtattgattggcgtgcagattggtctcggcaatattccgccgcatctggctttaccggcactgtttgccatcaacgcgcaggcggcctgcgacttcatcccggtcggtttgtcgctggcggaagcccgtcaggacacggttcgcgtcggtgtcccttctgtactggtgagccgctttttaaccggcgcgccgactgtactgatcgcctggtttgtctccggttttatctatcaatagaggctgaaacatgaccgttatttatcagaccaccatcacccgtatcggcgcgagtgccattgacgccctcagtgaccagatgctcatcacctttcgtgaaggcgcgcctgcggacctcgaagagtattgcttcattcattgccacggcgagttgaaaggtgcactccatcccggtttgcaattttcactcgggcagcatcgctatccggtgaccgctgttggcagcgtggcggaagacaaccttcgcgaactgggtcatgtcaccctgcgcttcgatggtttaaacgaagcggaatttccgggcactgtccatgtggcaggccctgtccccgacgatatcgcgccgggatcggttttgaagtttgaatctgttaaggagtaaaaaatgaatcaggttgccgttgtcatcggtggtgggcaaaccttaggcgcgttcctgtgccacggtctggctgccgaggggtatcgcgtcgcggttgtcgatattcagagcgacaaagccgcaaatgtggcacaagaaattaacgccgaatatggtgaaagtatggcgtacggttttggtgctgacgccactagcgagcaaagcgttctggcgctctctcgtggggtagatgaaatctttggtcgcgtggatttgctggtctacagcgccggaatagcaaaagcagcctttatcagcgacttccagctcggcgattttgaccgttcgctacaggtgaatctggtgggttatttcctgtgtgcgcgtgaattttcgcgtttgatgatccgcgacgggattcaggggcgcattattcagatcaactcgaaatccggcaaagtgggcagcaaacacaactctggctacagcgcagcgaaatttggtggcgtcgggctgactcaatcactggcgctggatctggcggagtacggcattacggtgcattcactgatgctcggtaacctgctgaaatcgccgatgttccagtcactgttgccacaatacgcgaccaagctgggtatcaaaccggatcaagtcgagcagtattacatcgacaaagtaccgctcaaacgcggctgcgattatcaagatgtgctgaatatgctgctgttctacgccagtcctaaggcgtcgtactgcaccggacagtcgatcaatgtcaccggcggtcaggtgatgttctgatcaacagcggagatccattaaggatctccgtgagactatagaatgcctgatgcgctacgctcatcaggcatacaggacttccgccactacattaaggaaaagttatggtatccgcactcatcaccgtcgccgttatcgcctggtgtgcgcaactggccttaggcggctggcaaatttctcgttttaaccgtgccttcgacacactatgccagcaagggcgggttggcgtgggccgttccagcgggcgctttaaaccgcgggtcgtggtcgccatcgcgctggacgatcagcagcgcatcgtcgacaccttgtttatgaaaggactgaccgtcttcgcccgaccgcaaaaaattcccgcaattaccggtatgcatgcgggtgatttacagcccgatgtgatctttccccatgatccactatcacagaatgctctatcattggcgcttaaactgaaacgtggataatttcgttgtgaatgttacttgcttgcgaagttatcattttgaaacctaaatcaggtaatcacgcccatgaaacctcgtcagcgtcaggccgccattctggagtatctgcaaaagcagggtaaatgctcggttgaagaattggcgcaatactttgacaccacaggcacaaccattcgcaaagatctggtcattctggaacatgccggaaccgtcattcgtacttatggcggagtggtgttgaataaagaggaatccgatccgcctatcgatcataaaacactcatcaacacccacaagaaagagctgattgcagaagctgccgttagttttatccatgatggcgattcgatcattcttgatgctggcagtaccgttttgcagatggttcccctgctctcgcgctttaataacatcacggtgatgaccaacagcctgcatatcgtcaatgcgctatccgaactggataacgaacaaactatcctgatgccaggcggaacgtttcgcaaaaaatcggcctcatttcacgggcaactggcagagaatgccttcgagcatttcaccttcgataaattgtttatgggcaccgacggcatcgatctcaatgcgggcgtaaccacctttaacgaggtttataccgtcagtaaggcaatgtgcaatgccgcgcgcgaagtgattttgatggcggactcatcaaagtttggccgtaaaagccccaacgtagtttgcagtcttgaaagcgtcgataagctgattaccgacgcaggtatcgatccggcgtttcgtcaggcgctggaagagaaagggatcgatgtgatcataaccggagagagcaatgagtgaagcactactgaacgcgggacgtcagacgttaatgctggagttgcaggaagcaagccgtttaccggaacgtctgggcgatgattttgttcgcgccgccaatatcatcctgcactgtgaaggcaaagtggtggtttcgggaattggcaaatcgggccacattggtaagaaaatcgccgcaacgcttgccagtaccggcactccggctttttttgtccatccggcagaagcgctgcacggcgatctggggatgatcgaaagccgcgatgtgatgctgtttatctcttactccggtggcgcgaaggaactggatctgattattccgcgtctggaagataaatctatcgcgctgctggcgatgaccggcaaaccgacgtcaccgctgggcctggcggcaaaagcggtgctggatatctccgtagaacgcgaagcctgcccgatgcaccttgcgccgacctccagcaccgtcaataccctgatgatgggtgacgcgctggcgatggcggtcatgcaggcgcgcggatttaatgaagaagattttgcccgctcccacccagccggggcactgggcgctcgcttgctgaataaagtgcatcatctgatgcgccgtgacgatgccatcccacaggtggcgttaaccgccagcgtgatggatgcgatgctggaactcagccgcaccggtctggggctggtggcggtatgtgacgctcaacaacaggtacaaggcgtctttaccgacggcgatttacgtcgctggctggttggcggcggcgcactcaccacgccagtcaatgaagcgatgacggtcggcggcaccacgttgcaatcgcaaagtcgcgccatcgacgccaaagagatcctgatgaagcgcaaaatcactgccgcaccggtggtggatgaaaacggcaaactcaccggcgcaataaacctgcaggatttctatcaggccgggattatttaatccttcaatcccagacgtttcgccagccgatgcaggttggcgacgtcggtttccagcatccgcgcgcaggcagcccagttgtgatgattttgtgccagtgcctgacgaatagtttcacgctggaacgcttctgtcgcttcacgcaggttttgcttaacaacgggcaccgccgccacttctggcgtcggcaacgtcacctcaggaaaagcaaaatgttgcgcctcaagaatcacttcatcgccgctgcgggtggctctcgccagaactaccgcccgatgaatagcatgttccagttcgcgcacgtttcccggaaaactgtagtgttgcagtaaatttcgcgctccggcacttaataccacgcgggagagcccctgccgcaaacgacactgctcgcagaaataccccgccagcagaatgacatcatcgccccgctcacgcagcggcggcaccgaaagtggaaacacgctcaggcgatgaaacaaatcggcgcggaatcgccctgccagcacctcttcgcgtaaatcgcggttagtcgccgccagcacgcgcacatcgacccgcaaacaacggtcatcgccaacgcgctgaatatcgccatactgcaacaccctcagcagcttggcctgcaatgccaacgacaactcgccgatctcatccagaaacagcgtgccgttatccgccatttcaaacttcccgctgcgattactgatagcgccagtaaacgctcctttcacatgcccgaacaactcactttccgccacactttccggcagtgcagcacagttgagatagaccagcggattcaccgcccgtggcgaggcttcatgaatcgctttcgccaccagctccttaccggttccagtctcaccgctgatcaggacgttgagatcggacgccgccacaatctcaatctcttttttcagttgcgtcatgccaggggacaagccaatcatctgcgtctgtttcaccgcttcaaacggcgtggcatcgcctggcagcatattctggctttccagttgttcaatcagcaacgcattgcttaacgctcccgccgccagcgcagcaatcagccgtagctcttcgtcgctgaaaacatcgaactgatcgggctgcatcccgtcgagcgtcagtgcgccgatcaggttttgcccggcaaacaatggcagaccaacgcaggcgtgaaccttcagactctcctgcccaggaatcaaaccgtcatagggatcgggcaattcgctgtctgcgggaaagcgcaccacatccccggcgcgggcaatcgcttccagccgtggatgcccttccagcgcaaagcgtctaccgagtacatcctttgccagaccgtcgatggcaagcggaataaactgccgcgaatcgtaacgtagcaacgcagacgcatcgcactccagcacctgacgtagcgtggtgatcaggcgctgaaaacgatcctggtgaccaatcccacgctgcaattcgatggcgatattcgccagcacatcaacggaaaaactcatctttgcctcactgtcaatttgactatagatattgtcatatcgaccatttgattgatagtcattttgactactcattaatgggcataattttatttatagagtaaaaacaatcagataaaaaactggcacgcaatctgcaattagcaagacatctttttagaacacgctgaataaattgaggttgctatgtctattgtggtgaaaaataacattcattgggttggtcaacgtgactgggaagtgcgtgattttcacggcacggaatataaaacgctgcgcggcagcagctacaatagctacctcatccgcgaagaaaaaaacgtgctgatcgacaccgtcgaccataaattcagccgcgaatttgtgcagaacctgcgtaatgaaatcgatctggcggatatcgattacatcgtgattaaccatgcagaagaggaccacgctggggcgctgaccgaactgatggcacaaattcccgatacgccgatctactgtacagccaacgctatcgactcgataaatggtcatcaccatcatccggagtggaattttaatgtggtgaaaactggcgacacgctggatatcggcaacggcaaacagctcatttttgtcgaaacaccaatgctgcactggccggacagcatgatgacttacctgacaggcgacgcggtgctgttcagtaacgatgctttcggtcaacactactgcgacgagcatctgttcaacgatgaagtggatcagacggagcttttcgagcagtgccagcgttactacgccaatatcctgacgccgttcagccgcctggtaacaccgaaaattaccgagatcctgggctttaacttaccagtcgatatgatagccacttcccacggcgtggtatggcgcgataacccgacgcaaattgtcgagctgtacctgaaatgggcggctgattatcaggaagacagaatcaccattttctacgacaccatgtcgaataacacccgcatgatggctgacgctatcgcccaggggattgcggaaaccgacccacgcgtggcggtgaaaattttcaacgtcgcccgaagcgataaaaacgaaatcctgactaatgtcttccgctcaaaaggcgtgctggtcggcacttcgacgatgaataacgtgatgatgccgaaaatcgccgggctggtggaggagatgactggtttacgcttccgtaacaaacgcgccagtgctttcggctctcacggctggagcggcggtgcggtggatcgtctttccacgcgcctgcaggatgcgggtttcgaaatgtcgcttagcctgaaagcgaaatggcgaccagaccaggacgctctgaagttatgccgtgaacacggtcgcgaaatcgcccgtcagtgggcgctcgcgccgctgccgcagagcacggtgaatacggtagttaaagaagaaacctctgccaccacgacggctgacctcggcccacggatgcagtgcagcgtctgccagtggatttacgatccggcaaaaggcgagccaatgcaggacgttgcgccaggaacgccgtggagtgaagtcccggataacttcctctgcccggaatgctccctcggcaaagacgtctttgaagaactggcatcggaggcaaaatgagtaacggcattgtgatcatcggttcgggcttcgccgcccgccaactggtgaaaaatattcgcaaacaggacgccactattccattaaccctgattgccgccgacagcatggatgagtacaacaaacctgacctcagccatgttatcagtcaggggcaacgtgccgatgaccttacccgccagacggcgggtgaatttgccgagcagtttaatctgcacctgtttccacaaacctgggtgacggatatcgatgccgaagcccgtgtggtgaaaagccagaataatcagtggcaatacgacaagctagtactggcaaccggtgccagtgcctttgtcccgcctgtgcctgggcgtgagttaatgctgacgttaaatagtcagcaagagtatcgcgcctgtgaaacgcaactgcgggatgcccgacgcgtgttgattgttggcggtggtttgattggtagcgaactggcgatggatttttgtcgtgcaggcaaagcggtcacgctaatcgacaacgctgccagtattctggcgtcgttaatgccaccggaagtaagcagccgcttgcagcatcggttgacggagatgggcgttcatctgctgttgaaatctcagttacaggggctggaaaaaacggattctggcattcaggcaacgctggaccgccagcgcaatatcgaagtggatgcggtaattgccgccaccggactgcgcccggaaaccgccctggcacgacgcgccgggctgacgattaatcgcggcgtttgcgtcgatagttatctgcaaaccagtaataccgatatttacgcgctgggcgattgcgcggaaattaacggtcaggtattgccgttcctccagccgattcaacttagcgcgatggtgctggcaaaaaatcttctcggcaataacacgccgctgaaactcccggcgatgctggtgaaaatcaaaacgccggaattaccgctgcatctggcaggcgaaacccagcgtcaggatttacgctggcaaattaataccgaacgccagggaatggtggcgcgcggcgttgacgatgctgaccagcttcgcgcctttgtggtcagtgaggatcggatgaaagaggcatttggattgttgaaaacattgccgatgtaggtgggctactgtgcctaaaatgtcggatgcgacgctggcgcgtcttatccgacctacggggacgcatgtgtaggccggataaggcgtttacgccgcatccggcaatggtgtccaaatgcaacacgttttatccgttctggacttcacccgctaaccaacgcgccgcagcaataaccccctgccccagagacaaaccgccatcacccgccggtaaactctgtggaaagagcaatgtgaaatcagcgagataatgcgccagacgtgcacgcagcaaacggttatgaataaccccgccgctaaataccagcgtagtgataccacgcatcgtggcctgctcacgcatcaacgcggcaaaaccctgcgccagcgcatcatgaaacgcccacgcgcgttgattaaccggtgcctgccagttcagccactgctgccagaaagtggcgagatccagttgattgtccacccgcggcattgtcaccggatgcgtcactccgtggcatgaggctgcgagcgcctccagagcacaagccgcttcaccttcataacttaacgtggctggcgcacagcccagtgccgccgccactgcatcgaaaaaacgcccacacgatgacgccagcggcgcgttaattccacgctcaatggcccgcgccagcacgctccagttttgctgttgcacacttgctgtttcagagtaattctgccactccggcacaaagcgcaggcactgcgccagcaggtttcgccacggctgcttcgctgccaaatcgccacccggaagcgccactgcaggcaagccgcccaggtgctcacattcgcgatagttcacccgcaggcactcgccgccccacaaagcgccgttctcccccataccgataccgtcgagcgtcaaagcaatgacatcaccgccatccagcggccactgatgctctgccagacacgccgctgcatgggcatgatgatgcagtaccgtttgcgtcggcagattcatttcacgcgcccactggctggagacatagcccggatgcgcgtcatgcacaacgtattgcggggtaaaatcgtagatgttttgcatcaggcgtaacgcttcgcgccactgcatctggatgccatcgtcacttaaatcgcccagatgctgactcaacaccgcttgttcaccgcgcaccaggcagaaggtatttttcagatccgcgccgagacacagcacaggcggaacatttttaaagcccggaggcaaagccagcgcatccggcacatacccccgcgaacggcgcagcatttcgccgctttcgcgcaccaccgaatcatccatccgctgcacgatgtcgcggttatgtatcaagaatccgtcggcaatgccctgcaaatccgccagcgcctgttcgttgctgatagctggtggtttaccgctcaggttgccggaggtcatcaccagcgggcattgcagttcctgtaacagcaaatgctggagcgggttcgcaggcaacattaccccgacttcgttaaggtcaggggcgatatcatcacaaagctcaggaacgtattttttatccaccagcacaatcggcgcggcgggcgtggtaagcaactggcgcgcagcgtctggtaaaccgtcagccactggcaacatgaccgccagcggtttcgccgggcgatgtttgcgcgcccgaagtgtcgccaccgcgttactgttacgtgcatcgcaggcaagatgaaatccgccaatccctttgatggcgacaattttgcccatttttaactgtgcgatagctgcctgtaatgccgcctcttgttccgcatgttcaccatgacttacccattcaagatgcgggccacactccgggcaggccaccggctgggcgtggaagcgacgatcgagcgggtcacggtactctttgtcacaggccggacatagcggaaacgccgccatcacggtaaacgggcggtcgtaaggcatggcgcgaataatggtgaaacgcgggccgcagtgggtacagttgataaacggataacgataacgccgttcgcctggggtattcatttcggcaaggcaagcagggcaagtagcggcatcgggaacaatttgcgtattcatggtgccgcctgtgctctggcgtatagtgaactcggtgggcagttgtgaccagataaacggctcacgctcgacgctatcaatacgcgccagcggcgggcagtgctgatacaattgaacaagaaacgtttccgggtcttcccgcagccggacttctacgccatcgccgtcattacagacatcgccgtgaagatttaattgctgtgccagctgccagacaaacggacgaaaaccgacgccctgcactttgccacgaatacgcagttggacaccgcaagatgtgttttttgccattgagttattcccgccatcatgaattgcgtaacccgccctgccggacacgacagcgtcgcatccggcagtcacaggtcggcgataccgcccgctccgtattctacgaatatttccgggaattcctttgatgccagaacagttctgtaagatttttagaacatcagcgccgtacggcggcgtttttctgcgctcagttgttcaagtttattacgatcgacacaaatcagcgcatgagtcgggcaagccgccatacacgccgggccgtcttcacgatggttgcacaggtcgcatttattggcttcggctttgtcagcccgtacattcagacccgcgccgctgttgcggatcaccggacgtaccaccacttccatcgcaccatacgggcaagccacaacgcaggttttgcaaccaatgcaacgttcctgcatcacatgaacaaaccctttatcacggctgatagcaccattcgggcagacgttagcgcacggtgcatcttcacactgacggcaaactgtcgccgtggaaatgttcacacctttaatgacatggatacgcggtaaaaaagtttccggggtcagcgatgcacagtcctgattttcctgatgagaaaccacgcacgctacttcacaggtacggcaaccaatacatttactcgcgtcagcaatgatgaaacggttcatcaaattctccagcaatgacagttaatgcgccgatacattcacaaatcatgccagtttttaatttactgttatttaaggaaattaatttctgtaatgcaggaaaaacgatgtcatcgacactagtgacgatgacatgtgatgacaatgtttatcgcgaaggagcaatgagtgagtcgcggcggatcagttttccgctgaaggttttcggcggtgagaaatccccgccatcgagcataaaaatcagccgtccaataatttcctgaatcatctcagtcaccggaatttttacgctggagagcgccggaacggtgtagggggcaatagcgatatcatcgaatccgataactgacacctgctctggcaccgctacgccgcgctcgtgtaacgctttcatcgcacctatcgccatatcgtcgttactggcaactaacgcgctaaatttagccccacgttcgagcaacatttctaccccttcggccccgctggcaggcgtccatttaccgttagcgataagtttttcattgagcgcaataccatgctgcgccagcgcgtctttatacccggcaagacgttcaatgctggtgggggaatccatcgagccggtaaggaaagcaatctcctgatgcccggcgtttatcaactctgccacggcgttaaaactggtctgtttatgatcgcaccagacgctatggctgctgtttttgcgcaggcggcgattaagcaccattatcggctgactgtgcgcgtcaatgatgtcatcgatctcatccacgcttaaaaaacgcgggtaaatcatgatcgcgtcgcagcgcagatccagcagatactgaatcgcctggcgctcttcttctgcgctgtgtttaccatctgccaatagcaactgccgccctttctcttccgccattcgcgcggcatgaaagagtaattcactaaaataaatgccgtggtaaagcgtgttggtcactaccagccccagcgtctgagtactcttcgccgacagattgcgcgccagcaagtttggacggtaaccgctctcttctaccgcctgaaacacgcgatctttagtctcctggctgacgtagccattacctgaaagcacgcgggaaacggtcgcttttgaaaccccggcgcgcttcgccacttccagcatcgtcgtcatcattttcatccctttacacgcaatcaacgcagtgtactgcaccgtttgccgattgtccttgcacaatcggcgggaaaaatattcaggtgaccggtttcacaaatataaaaaatgaacaattcactctcttgcttatttagtgacaactattcatgattttgtgaaaccggtttcttaattccgtttcagcatcggcatttttccgtcacgtcgactgataacaactacatctaccctactgataacaggataaaatccgatggccaaaaattatgcggcgctggcacgctcggtgatagcggcactgggcggcgttgataacatctcggcggtcacgcactgtatgacgcggttgcgctttgttatcaaagatgatgcacttatcgacagcccgacgttaaaaaccatccccggcgtgctcggcgtggtacgtagtgacaaccagtgtcaggtgattatcggcaataccgtttcacaagcctttcaggaagtcgtcagcctgctgccgggagatatgcagcccgcacagcccgtgggtaaacccaaactcacgctacgtcgcattggtgcggggatcctcgatgcgctgatcggcaccatgtcaccgctgatcccggcgattatcggcggatcgatggtcaaactgctggcaatgatcctcgagatgagcggcgtgctgacaaaaggatcgccgaccttaaccattctgaatgtgattggtgacggtgctttcttcttcctgccgctgatggtcgcggcatctgccgccatcaaatttaaaaccaatatgtcgctggcgattgccatcgcgggtgtgctggtacatccgagttttattgaactgatggcgaaagcggcccagggtgaacatgtcgaatttgccctgattccggtcaccgcggtgaaatacacctacacggtgatcccggcgctggtgatgacctggtgcctgtcatatatcgaacgctgggtggacagcattacaccggcggtgaccaaaaacttcctcaaaccaatgctgattgtgttgattgccgcaccgctggcaatcctgctgattggcccgattggtatctggatcggtagcgccatttcggcgctggtttacaccattcatggttatctgggctggctttcagtcgccattatgggcgcgctgtggcctctgctggtaatgaccgggatgcaccgcgtctttacgccaaccatcattcagaccattgccgaaaccggcaaagaagggatggtcatgccgtcagagatcggcgctaacctgtcgctgggcggttcatcactggcagtggcgtggaaaacgaaaaacccggaactgcgtcagacggcgctggctgcggcggcatcagccattatggcggggatttccgaaccggcgttatatggcgtggcgatccgcctgaaacgtccgcttatcgccagtcttatcagcggttttatttgcggcgcggttgccggtatggcggggcttgccagccactcaatggcagcgccggggctatttaccagcgtgcagttcttcgatccggcgaatccaatgagcatcgtctgggtgttcgcggtcatggcgctggcggtggtgctgtcgtttatcctcacactgttgctcggctttgaggatattcctgttgaggaagcggctgcccaggcgcgaaagtatcagagcgtacaaccgaccgtcgccaaagaagtaagtcttaattgaggatgaaaatgtcagtatttccagaaagttttttatggggcggcgcgcttgccgccaaccagtctgaaggtgcgttccgtgaaggtgacaaaggtctgaccactgtcgatatgatcccacacggcgagcatcgaatggcggtgaaactggggctggaaaaacgttttcagttgcgagatgacgagttttatcccagccatgaggcgacggatttttatcatcgttataaagaagatatcgccctgatggcagagatgggattcaaggttttccgtacctcaattgcctggagccgtctctttccgcagggcgatgaaatcacgcccaatcagcagggcattgctttttatcgttctgtctttgaagagtgtaaaaagtacggtatcgaaccgctggtcacgttgtgccacttcgatgtgccgatgcatctggtcaccgaatatggctcctggcgtaaccgcaagctggtggagtttttcagccgctacgccagaacctgctttgaagcatttgatggtctggtgaaatactggctaaccttcaatgaaatcaacattatgttgcatagcccgttctccggcgcgggtctggtgtttgaagaaggtgaaaatcaggatcaggtgaaatatcaggccgcgcatcaccagctggttgccagtgcgctagccaccaaaatcgcccatgaggttaacccgcaaaatcaggtgggctgtatgctggcgggcggtaacttctacccttacagttgcaagccggaagatgtctgggcggcgctggagaaagaccgggaaaacctgttttttatcgatgtgcaggcgcggggcacgtatccggcttactctgcccgcgtattccgcgaaaaaggggtaaccatcaacaaagcaccgggcgatgatgaaatcctgaaaaacaccgtcgattttgtctctttcagctattacgcctcgcgctgcgcctcggcggagatgaacgccaacaacagcagtgcggcgaacgtggtgaaatcgctgcgtaatccgtatctacaggtgagcgactggggctggggaattgatccactcggtctgcgtatcaccatgaatatgatgtacgatcgttatcagaagccgctgtttctggtggaaaacggcctgggcgcaaaagatgaatttgctgccaatggcgagattaacgacgactatcgcatcagctacttacgcgaacatatccgcgcaatgggcgaagcgattgcagacggcattccgctgatgggctacaccacatggggctgtattgatttagtttccgcctctacgggtgaaatgagcaaacgctacggctttgtctttgttgaccgtgacgacgcaggcaacggtacgctgacgcgcacgcgtaagaaatcattctggtggtataaaaaagtgattgccagtaatggggaagatttagagtaggtaacagtgccggatgcggcgtgaacgccttatccggcctacatgtcgcacgaaccatgaaggcccgataagcgcagcgcatcgggcaatttagcatttggcatcagagctggttcaccccatcaagaacatccctgtcctgattccttaatgaaaaactactcttcttccaccgctaactgcgcgaagccgccatttccttcccagccttccagtcgttgataaacggtttctaccgcatctttaatcggctgggtcatcgggtagtaaaagccgacgatatccggctgaatgccgaggaaaatcacttcgccaatatcttctttcaactggtcgataaggtaattcaacggcatgttatgggtagtcatcataaacatctcggcgatatcatccgggtcgatgatgcggatctcgccggggtttagccccatatccgtggcgtcgacaatcagcagtcgtgtcgggcgcagttcacggatagcgacgatgtcgttttccggtgcgctaccgccgtcaatcaccacccagttacctttcggcgcggcggcgcacttttccgccagcagcggacctgcgccatcatcgcccatcatgctattgccaacacagagtaaaacgtcagtcacgcagtctcctcaccatcaaatagatggcgttttcctgatgaatatcatgcagcatacttaacagcattgtactccattcctgctgctgcgaagtttgcgctgcccgggctttatcgaatgcgttggccagcatcggcacatggttaatgtcgatgacgatctcaccatatttcggcacgccttccattttgcggcgggcttcactgcctgcctccagagtggcaatccatgccagatattcatcccacgggcaggtgagcgccgcttccaggcaatcgataaccccaaggtggtgaccaatcgccaggctgtaatagaccacctgctgcgcctcggcgggcgtggcatcgttctcatcaataaatttacggctcagttgactgaacaccaccttttcactcatcggatacgcgcctcttcaacaacatgattcagatggctgacaatctcgttcagacgcggatcgttttccgcttccagccagcgtgcaacctgttcttcgccctgccctaactgtgtaaggtaatcatcggcaatctgacgaccgtaacgataacccgccaggcgacgtgcttcgcgatccactttcacgcgcagcggctgcaccatatcaccatgcaggatctccgccggttgttcatccagttcacccggcccacgggcgtgaattttctgctccagcaggccgagcgccattgcaaagccgtacagcgtggcggcaggcgttggcgggcagccagggatataaacatccacagggacaattttatccgtaccgccccacacgcagtagagatcgtggaagatcccgccactgttaccgcaggcaccgtaggagatacaaattttcgggtccggcgcggactgccacgcacgcagcgcaggggatcgcattgcacgggtgaccgcgccggtaaacagtaaaatatccgcatgacgcggtgaaggaacgactttaatgccgaagcgttctgcatcaaacagcggcgaaagcgtggcgaaaatttcgatttcgcaaccgttgcagccgccgcagtccacgcggtaaacataggcagaacgtttgatttttttcagtaacgacgccttcatgctggcgatggattcatccaccgtcatggggaccggaatgccgttggcgtcacgggggcctaataaattgctcatcagatggcctctttcatatggcgagtcagttcaatacggtcggacggcaccaggcatttctggcgcttacattccgggcaagtctcaaagctttcgcggtggttttccgcgcggctgtcgccgttgtgcttaagcagcgcaatggcgtagtcgatctctttctggacggcgaaaggacgattgcagacgcggcagttgcacagcgcgaagcgggactgttgcaggaagtcttctttcttccacaccgccagttcgtactcttgcgacagtttgatcgccgccgtcgggcagacttcttcgcagcgtccacagaagatgcagtgcccaagattaaactcccaggcaagctctcctgtggcgaggtcagtttcaaccgttaaggcgtttgacgggcaggcattgacgcaggccgcgcagccgatgcactgctgcgggttctgctctggcttaccacggaagtttttatcaaccgcaatcggctccagcggataagacgaggtcgccgtgccggttttgatgacttttttgataaaggtaaacatggcgattccttatttcagcggcgagtttttacgctcaatgctgtaacgctcgagttctttgtacggcaccactttgctcttcttcttacgcacatcgaccacggtcatgcggtcggtacaggagtagcaagggtcgaggctaccgataatcagcggcgcatcggaaacggtgttgccgcgcagcatgtagcgcagggtcggccagttcgcgtaggtcgcggcacggcagcgccagcggtacagcttctggttgtcgccggtcatgctccagtggatatcatcgccgcgcggcgcttcggcaaagcccagcgcaaagcggtgcggaatgtaggtaaagccttccaccatcagtgggccacccggcaggttatccagaccgtagtcgatcatgttcagcgcggtatagacttcgttgatacgcactttcagacgggaaataacgtcgcagccctgctcgctgtggacttccattggcagcaggccatagccgacaaacgggtgatcggcgcgggtatcacgggcgtgaccgctggcacggaccatcgggccgacgttactgaagtcgcgagcgatttccgggtccagacgaccaatgccgacagtgcgctgttccatgttcggagtgctcagcagcacatccaccagctcctgcacttcacgacgcatctgttgtgccagctggcgggtctggatcatgtcgtctttcagcagatcgcgacgaatcccgccgatcaagttcaggccgtaggttttacgcgcaccggtaaggatctctgccattttcatggaggtttcacgcacgcggaagaactgcataaagccggagtcgaagccggtaaagtgacaggccaggccaaggttgagcagatgcgagtgcaagcgttctacctccagcagaatggcgcggatcatctgcgcacgttctggcacctgaatacccatcgcgttttccaccgacgtggtgtaggcggtgctgtgggcaaagccgcagatcccgcacacacggtcagagaggaaggtcacttcgttataacccatacgggtttccgccagtttttccatgccgcgatggacgtagaacagacggtagtcggcgtcgataatgttttcgccatcgacgaacagacggaagtggcccggttcatcagaagtgacgtgcagcggaccaatcggcacgacgttgtttttcttgtcgcccagttcgttgatgaactcgtaggtttcagcatcggtggtcggtgccggacgctgacgataatccatgctgtctttacgcagcggataaagttcatccggccagtcatccggcagcaccagacgacgttcatccggcagaccaaccggaatcaaaccgtacatatcgcgcacttcacgctcgccccacaccgccgccggaacgcgcggcgtcacggacggatattccggtttgttggcgtcaacttcgacgcgaaccgtaatccaacacttagtgcccttctccatcgacagcacgtagtaaacggcgtaatgaccattcagtttgcgttcgtcgttaccaaacagcaccgacagccagccaccctgtttgtagtaaagaaactccaccacttccggcaggtagttcacctttacggtgacagtcagctgatctttggtctgccaggcgtggtccagcacgacgcccggaaatgcctcattcagcgcggcgagataatgttgacctaatttttcttcagacatgctcaaactctctttaatcacgccgccagcaaggagacgaacgctaaaaatgcaaagccaaacccagcccaggtaatgcgcggagtaatatcaagacgcagacgggccatgctgttttcgaacagcgcgataaccaggacgccgaccaccagttttacgatggcaatcaccagcgccagcagcagtccaccggcggtgaaggtttccatttgtccccacggaataaacaccccgacgaacatctgcaacaccaccagctgtttcaggctgataccccatttcatgacgccaaagccgctgccgctgtattcagagagcgggccttcctgcagctcctgctcggcttccgccaggtcgaacggcagtttgcccatttcgataaaggtggcgaacgcacaggcacaaagcgccagtaccagcgggatgctctggctcagcggccagtgataaacggtgtcggtgatgttgctgatgttggtggaaccggcaacctgtgcggcaacccacagaccaagcagcagcatcggttcgaccagcacgccaagcatcgcttcacggctcgcgccgatagcggtaaacgggctaccggtatccagaccagaaatggcaaagaagaaacgcgcgatggcaaagagatacagtaaggtgatcaaatcacccagttgcggcagcggagaaccgacggtcaccaccggcagcgcagtagcgatagtcagcatgacgcccaccatcacatacggcgtcaggcggaacacccagccggaggcatccgggccgacgctctgacgccccagcagtttgataatgtcgcgatactcctgcaacacgcccggcccgcgacggttatgcaagcgggcgcgcgccacgcgggttataccggagagcagcggcgcaacggcaaataacaccagcgcctgaattaacggatataaaacactcattctcaggctcctcgtgaaacaataatcaccaccagtaccgccagttcaaccagcgccatccggcggaacagcaacgcactcccctcgcactgccagcccggcaccagagacaccggattcagccatttgcgtagtttcagcaccggcgcaaacgcctgtttcaccggcatggcaaaaccgtgagcggtaatcaccattgatttttcgtggtcgtaaccgcacacccaggccgcaccgcgggaacgcgatggcaaacgatcgcctttgcaaatcgccataatgatgaatggcagcagcgggcaggcaatcagcagcaacgtgatcatcggttgagaaacggtggtgttagcaggctccagcggcagaggtacagcagcagagagcatcggcagtagccacggcgcagcaacaccgccaattacgcagcaaatcgccagtgccactacgcttacgctcatcaggagcggcgcacaggtggcgttttcggcttctttggtgcgcggcgcgccgaggaacgtgacgccatagactttcgccatacacatcaccgccagcgcaccggtaattgccagccccacagcgagcagcggccccagcagacgggcaacaaacgcgccactattgctcagtttgaaaaatgattgatagataacccattccccggcaaaaccattcagcggcggcagcgcagccattgccatcagcccgactaacatggcgatggagataaccggcattttcttgccaataccaccgagtttttcgatatcgcgatgaccggtacggaaccagacgctccccgccccgaggaacagtacgcttttgaacaggctatggttaagcagatggtacagaccaccgaccaggccaagagcaatcagcgccggttgttcgagcgcgatacccgttacgccagcgcccagccccagcaggatgatgccgatattttccagggtgtggtaagccagcaggcgctggatgttgtgctccaccagcgcatacagaccaccgacaaacgcggtgatcatgccgagcaccagcagcgcgatcccccaccacagcggtgcattaccgcccagcagtgacagggttaaaatgcccagcaggccaattttcatgactaccgtagaaaacaacgcggcagctggcgcagaggcgttcgcatgtgcctgcggcacccagccgtgcagcggaataatcccggccagcaggccaaagccaatcactccgagcagccagatatcggaaccgagcggcagctgttgcatacgcatatccagcaggcgcagatccagcgtgccgtaacgctgccacagcagccagcaagcaatcgccagcagcagagtgccaagacgccccagcgcaaaccacagtttgccctctttgctgttgctggtgaggaacaccgcgcacagggccatgatttcggccattaccacgaacatgccgaggttgctggcaatgacggcgcagacggcggcagccatcaacatattgatctgcaagccgttgcacttcacctgcgcgtggcgatgccagtcaatgttgtagaggctgacaaacagaccgcacagaccgagcgtaatcagccaaatcgcgttaagcggagagatttgcacatcgtagcttaccagcgacagcgcaccgctcacgccaaccgcgccagtcagtacagtgaagcccgcggctgccgtatacagactaccaaccgcgccgccaattccagctatccagccacttaacgctttttgaaaagaaaagagaaatgccagaacagcggcggcgacaaaccacgccacgccgctattgatcagggaaattgcgctcatttagcctctccactttgagcctgctgaaacaaggtgagatcgccaaagtccgtgttaaaggtcagctcacgcttacgtttgctgacgcgggcgatatcggtgttatccaccagatgcagggctttagtcgggcacatccgcacgcaggccggaccttgttcatcaaagctacaaaggtcacatttgacggcgatcgcgcgaatacctggcacccagtcaagcaatgtgctgacacgcgccggagcaggcggtgccggtggcgctttcggggtattggcgtttgccggaatatccagcggacggctgccggaaaattcaattgcgccaaacgggcaggcgatgccgcacagcttgcagcttacgcacaggctttcattcaactgcacggccccatcgacgcgggtgatggcgttaaccgggcagaccaccgcgcagggtgcatcttcacagtggtgacagagctgcggcgcagattctttttcattcagcatcactctcaggcgcggcattgattgcaggccgtgctggcgatgcgtctctgaacaggcggcctcacaagtgtggcagccgatacagagcgtggagtcagcaattacaaaacgattcaccaggcattcctcaggtgattgtcatttttgacgaaaacatgccgatgaaatgtcattttcgacactcatcgacacgcccatccccaaacaggcgtaacgcctgcaaaacgggcaaagcctcagctcatgctgccgggctttgtccctttaccagttggcttaaattcaccggcacattgttttcaatagcggtgtataagctgtcgtaaacgccagcgattttttcgagatagtgttccagaacctgttcgcgatcgcggatgttgaccttgccatcaatcatgccgtcaatgctcagttgcgcctgcgcaatccgctgtttgtcttcgccatcttttgtttcgacgtaatactcgatggtgtggctgttaaagccatccgccagggtgacgtaaatgcgaaaatgttcaaaaaggacgaaacagagttctttgtccggcgcgcagctcatggcgtgatgcaggcgcgctttcgataacgtgatcccctgaaccagcgaattgcagtagatgtgccactggtcctgtaggcgacgatgccgctgtgcgatgtaatcggctttctcgcttatttcccaaatagtcattgtcaggttacccgtttaacagagatgccagctttaagcattttttgtgccaacttttaatttattgttattaaagagatttttaagctaaagatgaatttcgtcgccgtgtcgacgtgtcatttcgacatcatcgacattattcaccgcagggataatcaacactggcacaattattgcttgtagctggcaatagttaatgggaggcgatatgcacgaaataaccctctgccaacgggcactggaattgatcgaacagcaggccgcaaaacacggcgcaaaacgcgtaactggggtctggctcaaaattggcgcattttcttgtgtcgaaaccagctctcttgccttttgttttgatctggtttgccgcggcagcgtggcggaaggttgtaaactgcacctcgaagaacaagaggccgaatgctggtgtgaaacatgccaacagtatgtgacgctactgacccagcgcgtccgccgctgtccacagtgtcatggtgacatgctgcagattgtggcagacgacggtttacagattcggcggatagaaatagaccaggagtgagcgatgtgtacaacatgcggttgcggtgaaggcaacctgtatatcgagggtgatgaacataaccctcattccgcgtttcgtagcgcgccatttgccccggcggcacgcccgaagatgaaaatcaccggcattaaagcgcctgaatttacccccagccagactgaagaaggcgacctgcattacggtcatggcgaagcgggcactcacgcaccgggcatgagccagcgtcggatgctggaagtcgaaattgacgtgctggacaaaaataaccgtctggctgaacgcaaccgcgcgcgctttgctgcccgcaagcaactggtgctcaacctggtttccagccctggttccggtaaaaccaccctgctgacggaaaccctaatgcgcctgaaagacagcgttccgtgcgcagttattgaaggcgaccagcaaaccgtgaacgatgccgcacgcattcgcgctaccggcacaccagcgattcaggtgaacaccggtaaaggctgccatcttgacgcacagatgattgccgacgccgcaccgcgtctgccactggacgataacggtattctgtttatcgaaaacgttggcaacctcgtatgcccggccagcttcgatctcggtgaaaaacacaaagtggcggtgctttccgttaccgaaggtgaagacaaaccactgaaatatccgcatatgtttgccgccgcctcgctgatgctgctcaacaaagttgacctgttgccgtatctcaactttgacgttgaaaagtgcatcgcctgcgcccgcgaagtcaatccagaaattgaaatcatccttatttccgccaccagcggcgaagggatggaccagtggctgaactggctggagacacagcgatgtgcataggcgttcccggccagatccgcaccattgacggcaaccaggcgaaagtcgacgtctgcggcattcagcgcgatgtcgatttaacgttagtcggcagctgcgatgaaaacggtcagccgcgcgtgggccagtgggtactggtacacgttggctttgccatgagcgtaattaatgaagccgaagcacgcgacactctcgacgccttacaaaacatgtttgacgttgagccggatgtcggcgcgctgttgtatggcgaggaaaaataatgcgttttgttgatgaatatcgcgcgccggaacaggtgatgcagttaattgagcatctgcgcgaacgtgcttcacatctctcttacaccgccgaacgccctctgcggattatggaagtgtgtggcggtcatacccacgctatctttaaattcggcctcgaccagttactgccggaaaacgttgagtttatccacggtccggggtgcccggtgtgcgtactgccgatgggtagaatcgacacctgcgtggagattgccagccatccggaagtcatcttctgtacctttggcgacgccatgcgcgtgccggggaaacagggatcgctgttgcaggcaaaagcacgcggtgccgatgtgcgcatcgtttactcgccgatggatgcgttgaaactggcgcaggagaatccaacccgcaaagtggtgttcttcggcttaggttttgaaaccactatgccgaccaccgctatcactctgcaacaggcgaaagcgcgtgatgtgcagaatttttacttcttctgccagcacattacgcttatcccgacgttgcgcagtttgctggaacagccggataacggtatcgatgcgttcctcgcgccgggtcacgtcagtatggttatcggcaccgacgcctataattttatcgccagcgattttcatcgtccgctggtggttgctggattcgaaccccttgatctactacaaggcgtggtcatgctggtgcagcagaaaatagcggcccacagcaaggtagagaatcagtatcgtcgagtggtaccggatgccggtaacctgctggcgcaacaggcgattgccgatgtgttctgtgtcaacggcgacagcgaatggcgcggcttaggcgtgattgaatcttctggcgtgcacctgacgccggattatcaacgattcgatgccgaagcacatttccgcccggcaccgcagcaggtctgcgatgacccgcgcgcgcgttgtggtgaggtattaacgggcaaatgtaagccgcatcaatgcccgctgtttggtaacacctgtaatcctcaaaccgcgtttggtgcgctgatggtttcctccgaaggagcgtgcgccgcgtggtatcagtatcgtcagcaggagagtgaagcgtgaataatatccaactcgcccacggtagcggcggccaggcgatgcagcaattaatcaacagcctgtttatggaagcctttgccaacccgtggctggcagagcaggaagatcaggcacgtcttgatctggcgcagctggtagcggaaggcgaccgtctggcgttctccaccgacagttacgttattgacccgctgttcttccctggcggtaatatcggcaagctggcgatttgcggcacagccaatgacgttgcggtcagtggcgctattccgcgctatctctcctgtggctttatcctcgaagaaggattgccgatggagacactgaaagccgtagtgaccagcatggcagaaaccgcccgcgcggcaggcattgccatcgttactggcgatactaaagtggtgcagcgcggcgcggtagataaactgtttatcaacaccgctggcatgggcgcaattccggcgaatattcactggggcgcacagacgctaaccgcaggcgatgtattgctggtgagcggtacactcggcgaccacggggcgactatccttaacctgcgtgagcagctggggctggatggcgaactggtcagcgactgcgcggtgctgacgccgcttattcagacgctgcgtgacattcccggcgtgaaagcgctgcgtgatgccacccgtggtggtgtaaacgcggtggttcatgagttcgcggcagcctgcggttgtggtattgaactttcagaagcggcactgcctgttaaacctgccgtgcgtggcgtttgcgaattgctgggactggacgccctgaactttgccaacgaaggcaaactagtaatagctgttgaacgcaacgcggcagagcaagtgctggcagcgttacattcccatccactggggaaagacgcggcgctgattggtgaagtggtggaacgtaaaggtgttcgtcttgccggtctgtatggcgtgaaacgaaccctcgatttaccacacgccgaaccgcttccgcgtatatgctaataaaattctaaatctcctatagttagtcaatgaccttttgcaccgctttgcggtgctttcctggaagaacaaaatgtcatatacaccgatgagtgatctcggacaacaagggttgttcgacatcactcggacactattgcagcagcccgatctggcctcgctgtgtgaggctctttcgcaactggtaaagcgttctgcgctcgccgacaacgcggctattgtgttgtggcaagcgcagactcaacgtgcgtcttattacgcgtcgcgtgaaaaagacacccccattaaatatgaagacgaaactgttctggcacacggtccggtacgcagcattttgtcgcgccctgatacgctgcattgcagttacgaagaattttgtgaaacctggccgcagctggacgcaggtgggctatacccaaaatttggtcactattgcctgatgccactggcggcggaagggcatatttttggtggctgtgaatttattcgttatgacgatcgcccctggagcgaaaaagagttcaatcgtctgcaaacatttacgcagatcgtttctgtcgtcaccgaacaaatccagagccgcgtcgttaacaatgtcgactatgagttgttatgccgggaacgcgataacttccgcatcctggtcgccatcaccaacgcggtgctttcccgcctggatatggacgaactggtcagcgaagtcgccaaagaaatccattactatttcgacattgacgatatcagtatcgtcttacgcagccaccgtaaaaacaaactcaacatctactccactcactatcttgataaacagcatcccgcccacgaacagagcgaagtcgatgaagccggaaccctcaccgaacgcgtgttcaaaagtaaagagatgctgctgatcaatctccacgagcgggacgatttagccccctatgaacgcatgttgttcgacacctggggcaaccagattcaaaccttgtgcctgttaccgctgatgtctggcgacaccatgctgggcgtgctgaaactggcgcaatgcgaagagaaagtgtttaccactaccaatctgaatttactgcgccagattgccgaacgtgtggcaatcgctgtcgataacgccctcgcctatcaggaaatccatcgtctgaaagaacggctggttgatgaaaacctcgccctgaccgagcagctcaacaatgttgatagtgaatttggcgagattattggccgcagcgaagccatgtacagcgtgcttaaacaagttgaaatggtggcgcaaagtgacagtaccgtgctgatcctcggtgaaactggcacgggtaaagagctgattgcccgtgcgatccataatctcagtgggcgtaataatcgccgcatggtcaaaatgaactgcgcggcgatgcctgccggattgctggaaagcgatctgtttggtcatgagcgtggggcttttaccggtgccagcgcccagcgtatcggtcgttttgaactggcggataaaagctccctgttcctcgacgaagtgggcgatatgccactggagttacagccgaagttgctgcgtgtattgcaggaacaggagtttgaacgtctcggcagcaacaaaatcattcagacggacgtgcgtctaatcgccgcgactaaccgcgatctgaaaaaaatggtcgccgaccgtgagttccgtagcgatctctattaccgcctgaacgtattcccgattcacctgccgccactacgcgagcgtccggaagatattccgctgctggcgaaagcctttaccttcaaaattgcccgtcgtctggggcgcaatatcgacagcattcctgccgagacgctgcgcaccttgagcaacatggagtggccgggtaacgtacgcgaactggaaaacgtcattgagcgcgcggtattgctaacacgcggtaacgtgctgcagctgtcattgccagatattgttttaccggaacctgaaacgccgcctgccgcaacggttgtcgccctggagggcgaagatgaatatcagttgattgtgcgcgtgctgaaagaaaccaacggcgtggttgccgggcctaaaggcgctgcgcaacgtctggggctgaaacgcacgaccctgctgtcacggatgaagcggctgggaattgataaatcggcattgatttaactgcaaattgccggacagatctgcctgtccggcatactattcatgaggttttttcggacgatatttttccggcagttctggcaccggacgcttgtcatcgatgagatgacgcacggttaagatcggatgacgccacagcattctcggcccggcccaacgcataatctgtttcatctcttcacgctttgcaggctggtaacagtgcaccggacactgcttacaggctggtttctcttcgccgaacacacatttatccagccgcttttgcgcgtaaacaaacaacgcctcgtaatgctccggctccgctgacgcctgcgggcatttcgcttgataaagatcgatcatttttttaatcgtcagtttttcacgagagatacgcttgccggacatgctgcctccacctcattaagatgtatttatattacatcttaatcttaaagggcactatgactccaaagaagaagggttagccaaccgatacaattttgcgtacttgcttcataagcatcacgcaaaagctgcaaaacagcatctttcccggaaccagcatcaagaactcgccgttcgcttcttcccctgaaatgattaactccggtatcatgtgcgccttatgtgattacaacgaaaataaaaaccatcacaccccatttaatatcagggaaccggacataaccccatgagtgcaatagaaaatttcgacgcccatacgcccatgatgcagcagtatctcaggctgaaagcccagcatcccgagatcctgctgttttaccggatgggtgatttttatgaactgttttatgacgacgcaaaacgcgcgtcgcaactgctggatatttcactgaccaaacgcggtgcttcggcgggagagccgatcccgatggcggggattccctaccatgcggtggaaaactatctcgccaaactggtgaatcagggagagtccgttgccatctgcgaacaaattggcgatccggcgaccagcaaaggtccggttgagcgcaaagttgtgcgtatcgttacgccaggcaccatcagcgatgaagccctgttgcaggagcgtcaggacaacctgctggcggctatctggcaggacagcaaaggtttcggctacgcgacgctggatatcagttccgggcgttttcgcctgagcgaaccggctgaccgcgaaacgatggcggcagaactgcaacgcactaatcctgcggaactgctgtatgcagaagattttgctgaaatgtcgttaattgaaggccgtcgcggcctgcgccgtcgcccgctgtgggagtttgaaatcgacaccgcgcgccagcagttgaatctgcaatttgggacccgcgatctggtcggttttggcgtcgagaacgcgccgcgcggactttgtgctgccggttgtctgttgcagtatgcgaaagatacccaacgtacgactctgccgcatattcgttccatcaccatggaacgtgagcaggacagcatcattatggatgccgcgacgcgtcgtaatctggaaatcacccagaacctggcgggtggtgcggaaaatacgctggcttctgtgctcgactgcaccgtcacgccgatgggcagccgtatgctgaaacgctggctgcatatgccagtgcgcgatacccgcgtgttgcttgagcgccagcaaactattggcgcattgcaggatttcaccgccgggctacagccggtactgcgtcaggtcggcgacctggaacgtattctggcacgtctggctttacgaactgctcgcccacgcgatctggcccgtatgcgccacgctttccagcaactgccggagctgcgtgcgcagttagaaactgtcgatagtgcaccggtacaggcgctacgtgagaagatgggcgagtttgccgagctgcgcgatctgctggagcgagcaatcatcgacacaccgccggtgctggtacgcgacggtggtgttatcgcatcgggctataacgaagagctggatgagtggcgcgcgctggctgacggcgcgaccgattatctggagcgtctggaagtccgcgagcgtgaacgtaccggcctggacacgctgaaagttggctttaatgcggtgcacggctactacattcaaatcagccgtgggcaaagccatctggcacccatcaactacatgcgtcgccagacgctgaaaaacgccgagcgctacatcattccagagctaaaagagtacgaagataaagttctcacctcaaaaggcaaagcactggcactggaaaaacagctttatgaagagctgttcgacctgctgttgccgcatctggaagcgttgcaacagagcgcgagcgcgctggcggaactcgacgtgctggttaacctggcggaacgggcctataccctgaactacacctgcccgaccttcattgataaaccgggcattcgcattaccgaaggtcgccatccggtagttgaacaagtactgaatgagccatttatcgccaacccgctgaatctgtcgccgcagcgccgcatgttgatcatcaccggtccgaacatgggcggtaaaagtacctatatgcgccagaccgcactgattgcgctgatggcctacatcggcagctatgtaccggcacaaaaagtcgagattggacctatcgatcgcatctttacccgcgtaggcgcggcagatgacctggcgtccgggcgctcaacctttatggtggagatgactgaaaccgccaatattttacataacgccaccgaatacagtctggtgttaatggatgagatcgggcgtggaacgtccacctacgatggtctgtcgctggcgtgggcgtgcgcggaaaatctggcgaataagattaaggcattgacgttatttgctacccactatttcgagctgacccagttaccggagaaaatggaaggcgtcgctaacgtgcatctcgatgcactggagcacggcgacaccattgcctttatgcacagcgtgcaggatggcgcggcgagcaaaagctacggcctggcggttgcagctctggcaggcgtgccaaaagaggttattaagcgcgcacggcaaaagctgcgtgagctggaaagcatttcgccgaacgccgccgctacgcaagtggatggtacgcaaatgtctttgctgtcagtaccagaagaaacttcgcctgcggtcgaagctctggaaaatcttgatccggattcactcaccccgcgtcaggcgctggagtggatttatcgcttgaagagcctggtgtaataacaattcccgatagtcttttgctatcgggaatattaacgacaactgacgaataaaataaaaacaccctgtataataggaaagcttattttacagggtaaaaccatgccatctacacgctatcaaaaaatcaatgcccatcactatcgccatatatgggtcgttggtgatattcatggtgaatatcagttattacaatcccgcttacatcaactctcttttttccccaaaatcgacttacttatttctgtcggcgataatattgatcgtggaccggagagtcttgacgtcctgcgcctgctaaaccaaccctggtttacgtcggttaaaggcaaccacgaagcgatggcgcttgaggcattcgaaactggcgatggcaatatgtggcttgccagcggtggtgactggtttttcgatttaaatgattcagagcaacaagaggcaatagatctgttgctgaaattccatcaccttccacatattattgaaatcactaacgacaacataaaatatgccatcgcacatgcagattatccggggagtgaatatctctttggtaaagaaatagcggagagcgaattactctggcctgttgatcgtgtgcagaaatcgcttaatggcgagttacaacaaataaacggcgctgattattttatatttggacatatgatgtttgataacattcagacgttcgctaaccagatttatattgataccggatcgccgaacagcgggcggctgtcattttataaaataaagtagtctcatgcttcttctgtgaagcatgagtaacccggtgttattgcaggccattattcatttttcgctaccagcaaagagagatcctgcttcaccagcgcgcgactggcactctccggcaaaccgtcgtctgtaataatctgatcaaactcgcttaatggtaacgccagccatgtcgccacctgaccatatttcgtcgcatcacagaccaaaactcgctggcggctggcactggcaatcgcccgtttcaccgtgactttatcttccgctggcgtagaaatcccccgcacactccatgacgatgcagaaataaaagcctgatcaatcatcaggctgcgcagcatggtcgcagcggcttccccgacacaggaacggttttcccgacacactgcaccgccagtgtgaataattgtgcaattactgttgtcgagcaagtagtccgcaataacgaaatcgtttgtgaccacagtcagtgactccatgtgaatcagatgctgtgctatcgctaacgtggtcgttcccgcatccagatagatacaacttcccggctgaacaagacttgccgccagcttgccaatagccgctttttgcgtcattgccagcgcagtttttacctgatgagaaggttcatgcgccacgcgtcccggagactggacgcctccggacaccagcacaacggctccctgctgctccagtttttgtaaatcccgacgaatggtcatatgtgacacattcattctgtccgttagttcagcaatactgacaatgcctttttcagctaccatctcaaggatgatttggcgacgctctacgggtatcaacttttgctccttcctttgtcctgctgacattctacgctatttgcctgcgaaacgtgcgcggcgcaactaacgcttagttcacataaaataacacacaatgttaatttatgtgaatcagatcaccataccgttatcttccagcgcttatattcacaatatcaaacaaaatatcacttaaattaacaaggagagcagatgaaaacgggatctgagtttcatgtcggtatcgttggcttagggtcaatgggaatgggagcagcactgtcatatgtccgcgcaggtctttctacctggggcgcagacctgaacagcaatgcctgcgctacgttgaaagaggcaggtgcttgcggggtttctgataacgccgcgacgtttgccgaaaaactggacgcactgctggtgctggtggtcaatgcggcccaggttaaacaggtgctgtttggtgaaacaggcgttgcacaacatctgaaacccggtacggcagtaatggtttcttccactatcgctagtgctgatgcgcaagaaattgctaccgctctggctggattcgatctggaaatgctggatgcgccagtttctggtggtgcagtaaaagccgctaacggtgaaatgactgtcatggcctccggtagcgatattgcctttgaacgactggcacccgtgctggaagccgttgccggaaaagtttatcgcataggtgcagaaccgggactaggttcgaccgtaaaaattattcaccagttgttagcgggcgtacatattgctgccggagccgaagcgatggcacttgcagcccgtgcggggatcccgctggatgtgatgtatgacgtcgtgaccaatgccgccggaaattcctggatgttcgaaaaccggatgcgtcatgtggtggatggcgattacaccccgcattcagccgtcgatatttttgttaaggatcttggtctggttgccgatacagccaaagccctgcacttcccgctgccattggcctcaacagcattgaatatgttcaccagcgccagtaacgcgggttacgggaaagaagacgatagcgcagttatcaagattttctctggcatcactctaccgggagcgaaatcatgatcaagattggcgttatcgccgatgattttaccggcgcgacggatatcgccagttttctggtggaaaacggtctaccaacggtacaaattaacggtgttccaacaggtaaaatgccggaagcaatcgacgcactggtgatcagcctgaaaacgcgctcctgtccagtggttgaagccacacagcaatcgctggcggctctgagctggttgcaacagcaaggttgcaaacagatctatttcaaatactgctctactttcgacagtacggcgaaaggtaatattggcccggttaccgatgccttaatggatgctctcgacacgccgtttacggtcttctctccggccctgccggtcaacggacgtacggtttatcaggggtatttgttcgtaatgaatcaactgctggccgaatccgggatgcgccatcacccggtaaatcccatgaccgacagctatcttccccgtctggttgaagcgcaatccacagggcgctgcggcgtcgtttcggcacatgttttcgaacaaggtgtggatgccgttcgtcaagagctggctcgcttacagcaagagggctaccgctacgcggtgcttgatgcgctgaccgaacaccatctggaaattcagggagaagccttgcgcgatgccccactggtaacgggcggttctggtctggcgattggcctggcccggcagtgggcgcaagaaaacggtaaccaggctcgcaaagcagggcgtccgctcgctgggcgcggcgtagtgctctccggttcatgctctcaaatgaccaaccgccaggtagcacattaccgtcaaattgcaccagcccgtgaagttgatgtggcacgctgcctctcaattgaaactctggccgcttatgcacacgaactggcagagtgggttctgggccaggaaagtgtacttgctccactggtttttgccaccgccagcactgacgcattggcagcaattcaacagcaatacggtgcacaaaaagccagtcaggcagtagaaacactgttttctcaactagcggcgcggttagcagcggaaggcgtgacacgctttattgtcgcaggcggtgagacctccggcgtagtcacacagagcctgggaataaaagggtttcatattggcccaaccatttccccggcgtgccgtgggtaaacgcactggataagcctgtctcactcgcccttaaatctggcaacttcggtgatgacgcctttttttcacgagcccaaagagagtttttatcatgagcgatttcgcaaaagtagagcagtctttgcgagaggagatgacgcggattgccagttcattctttcagcgcggctatgcaaccggttcggctggcaatctgtcgctgcttttacctgacgggaatttactggcgacaccgacaggttcatgcctgggcaatctcgatccgcagcggctttccaaagtcgccgcggatggcgaatggttaagtggtgacaaaccctcgaaagaggtgctctttcatctggcgctgtatcgcaacaatccgcgctgtaaagcggtggtgcatttgcacagcacatggtcgacggcgctttcctgcctgcaagggctggacagcagcaacgttattcgtccgttcacaccatacgtggtgatgcggatgggaaatgtcccgctggtgccttattaccgaccgggcgataaacgcatcgcacaggatctggcggaactggcagcagacaatcaggcttttttactggcaaatcatggcccagtggtttgcggtgaaagcctgcaagaagccgccaacaatatggaagagctggaggaaacggcaaagctgatttttattctcggtgaccgcccgatccgttatctgaccgcaggtgaaattgcggaattaaggagttaatgcaatgcctcgttttgcagctaatttatccatgatgttcaccgaagtgccttttattgaacgcttcgccgcagcgcgaaaagccgggttcgatgctgtggaatttctgtttccctataactactccaccctgcaaatccaaaagcaactggagcaaaaccatctgacactggcgctgttcaataccgctcccggagatattaatgcgggggaatggggattatccgcccttcccggacgtgagcacgaagcacacgcagacatcgacctggcactggaatatgcattggcgctcaattgtgaacaagtccatgtgatggcaggcgtcgtgcccgctggcgaagatgctgaacggtaccgggcagtatttatcgataatatccgctacgctgccgaccgctttgcgccacacggcaagcgaatattagttgaagcactcagccccggcgttaagcctcattatctcttctccagccagtatcaggcactggctattgttgaagaggttgcgcgagataacgtgtttattcaactagatacttttcatgcgcaaaaagtagatggcaacctgacgcatttaatccgcgactacgccgggaaatatgcgcacgtacaaattgccggactacctgatcgacatgaaccggacgatggagaaatcaactatccgtggctgttccgcctgttcgatgaggtgggatatcagggctggatcggttgtgaatataaacctcgtggcctcaccgaagaagggcttggctggtttgacgcctggcgctaattcgttaaatccctaattacaacgtacccatacatccccccatctacggatggggtaggttaactataactttcagacagggtttcccatgtccacaattacattgttatgcattgcgttagctggcgtaatcatgctgttgctgctggtcatcaaggcaaaggtacaaccattcgttgctttgctcctcgtcagcctgttagtcgcacttgcggcaggtataccggcgggcgaagtgggtaaagtgatgatcgccgggatgggcggtgtgcttggttccgtcactattattattggtctgggcgctatgctggggcgtatgatcgaacactctggtggtgcagagtcactggctaattatttcagtcgcaagttaggtgacaaacgaactatcgctgcgctgactctggcagcgttcttcctcggtattcccgtcttctttgatgtcggctttattattcttgcgccaatcatttacggttttgccaaggttgccaaaatatcgccactcaaatttggcctgcctgtcgctgggatcatgctcactgttcacgtggcggtaccgccgcatccaggccctgtcgccgcagcggggttactccacgcagacatcggctggctaaccatcatcggtattgcgatttctattcccgtaggggttgttggctactttgcagcgaaaataatcaataagcgccaatatgcgatgtcagtagaagtactggaacagatgcaactggctccggccagtgaggaaggcgcgacaaaattaagcgataaaataaatccaccgggcgtcgcgctggtcacctcgctaattgttattcctatcgcgattatcatggcgggtacggtttccgcaacactgatgccgccttcgcatcccctgcttggtacgctacagctgatcggctcaccaatggtagctctaatgattgcgctggtgctggcattctggttattggctttacgtcgcggctggagcttacaacacaccagcgacattatgggctcagcgcttcctactgcggcggtagtgattttggttactggtgctggaggggtatttggcaaagtgctggtggaatcgggcgtcggcaaagcccttgccaacatgctacaaatgattgacctgcctctgttaccagccgcatttattatttcactggcgctgcgtgcatcgcaggggtcagcaaccgtagcaatactgacaaccggcgggttactctcagaagcggtgatgggattgaatccgattcagtgcgtattggtgacgctggcagcctgctttggtgggcttggtgcgtcacatattaatgactcagggttctggattgtgaccaaatatctggggttgtcggtagcagacggtctgaaaacctggacagtgttaacgaccattctcggttttaccggattcttaattacctggtgcgtatgggcggtaatttgaccttaataaaaaggtccgatgggcatcggaccttttattgtgcacagaaaaggccagcctcgcttgagactggcctttctgacagatgcttacttactcgcggaacagcgcttcgatattcagcccctgcgtttgcaggatttcgcgcaaacggcgcaggccttcaacctgaatctggcgaacacgttcacgggtgaggccaatttcacgacctacatcttccagtgttgccgcttcgtaccccagcaaaccgaatcgacgtgccagcacttcacgctgtttggcgttcagctcgaacagccatttgacgatgctctgcttcatatcgtcatcttgcgtggtatcttccggaccgttctctttttcatcggccaggatgtccagcaacgctttttcggaatcaccacccagcggggtgtctaccgaggtaatgcgctcgttaagacgaagcatacggctgacgtcatcaactggcttatccagttgctctgcgatctcttccgcacttggttcatggtccagcttatgggacaactcacgtgcggttcgcaggtaaacgttcagctcctttacgatgtgaatcggcaaacgaatagtacgggtttggttcataatcgcccgttcaatcgtctggcgaatccaccaggttgcgtatgttgagaagcggaaaccacgttccgggtcaaacttctctaccgcgcggatcagccccaggttgccctcttcgataaggtccagcaacgccagaccacgattgccataacggcgggcaatttttaccaccagacgcaagttactctcgatcatccggcggcgagaggcgacatctccacgcagtgcgcgacgcgcaaaataaacttcttcttcggccgttaacagtggtgaataaccaatctcaccaaggtaaagctgagtcgcgtccaacacacgctgtgtggctccctgcgataacagttcctcttcggccaaatcgttatcactgggttcctgttctactaaggccttttcgtcaaaaacctcaactccgttctcatcaaattccgcatcttcatttaaatcatgaactttcagcgtattctgactcataaggtggctcctacccgtgatcccttgacggaacattcaagcaaaagcctggttccgccgatttatcgctgcggcaaataacgcagcgggtttacggatttccccttgtaacgaatttcaaaatgcaagcgtgttgaactggttccggtgctacccatggtcgctattttttgccccgccttaacttcttgttgttcccggaccagcattgtgtcgttatgggcgtaggcactcaggtaatcatcattatgtttgatgataatcagattaccgtagccgcgcagcgcgttaccagcataaacaacgcggccatctgcggtcgcgataattgcctgtcctttgctgcctgcgatatcaatccccttgttgcccccctcagaagcgccaaaggtttcgatcactttgccctcagtcggccagcgccaggtggagataggcgtactggttgatgtactgctgacagtcggctcggttgtgcttgctgttggtaccgttacaggcgctgtgaccgtggtcgcagttggcttgttgttcggcaacattttgttagcactctgttcacccgaagactcagaatacgtaattgtcggttgcgacgcaacagcaacggtggaattttgtgcaggcttgatcacaactccttgctctgctgcgtcggcctgggtaatggcatttccgccagtgattggcgtaccggaagcattacccacctgcaaggtctgaccaacgttcagcgcgtatggtgcctgaatattgttgcgctgagcaaggtcacggaaatcgttgccagtaatccaggcgatatagaaaagtgtgtcgccttttttcacggtataggtactgccgctataactgcctttcggaatgttcccatactgacggttatagacgatgcgtccgttttccatctgtaccggctgctgagctactggctgcactggctggatttgcggttgttgagtagcctgaatttgtggctgctgcaccggctgaatttgcggttgctgcgctgtagacgtcgtccccattttcggcggcggcgtaatcaacataccagaattagtatttgcaggcgcattgccattaacggagctgaccggtgccggtggatttgaagtgtcagaacagcctgccagccatagcgaaaccagtgacaaagccgcaatgcggcgaacggtgaattttgggcttcccgcgctcatttatcccccaggaaaaattggttaataaccagtgacataattaccgtgcaaggcaccctactgaacactggaaaagatgttcacgatacgctgacctgcggcaaaataaccaggaaaaatccaggtatttcctcacgttttaagccagctcacccttcactaaagggacaaagcgcacggcctccacggtatcgataataaattcgcctccccgacgacgcacccgtttcaaatactggtgctcctcccctacgggtaagacgagaatcccgccttcgtccagctgcgtcattagcgcagttggaatttccggcggtgccgccgtaacaatgatagcgtcaaacggcgcacgtgcctgccaaccttgccatccatcgccatgacgggttgaaacattatgtaaatcaagatttttcaggcggcgacgtgcctgccactgcaagcctttaatccgttcaaccgagcaaacatgctggacaagatgcgccaggattgccgtttgatatcccgaaccggtgccaatttccagcacccgcgactgcggcgtcagctcgagtaattcggtcattcgcgccaccatatatggctgcgaaattgtctgcccctgacctatcggcaaagcgatattgtcccaggctttttgttcaaacgcttcatcaacgaatttttcacgcggcacggcggcaagtgcattcagcacctgctcatcctgaataccttgcgcacgtaattgatccagaagtgcttgtacgcgtctgcttaccattgcgtgccaactcccacgctgtttaaccagtctgaaaccacatcttgcgcgctatgcgcagttaaatccacatgcagcggcgtgatggagacatagccctcatctaccgcagcaaaatcggtccccggaccagcatcacatttaccgcccggcgggccaatccagtacagcgtattgccgcgcggatcttgctgcgggatcacctgatctgccggatgtcgtgtaccgcagcgcgtcacgcgaatacctttgatttgatccaagggtaaatccggaacgttaatattaagaatacgcccggtgcgcagcggctctttacacagtgcgcgcaaaattgaacaggttaccgccgcggcagtgtcgtaatgtttatgcccgtcaagcgagacggcaagcgccggaaaacctaaatgacggccttccatcgcggcggctaccgtaccggaataaataacatcatcccccagattcggcccggcgttaattccggacacaacaatgtccgggcgcggacgcatcagagcattcacgccaagatagacgcaatcggtcggggttcccatttgcacagcaatatcaccattttcaaaggtaaacgtgcgcagggaggattccagtgtcagagaatttgaagcgccgctgcggttacgatcgggggcgaccacctgaacgtcagcaaactcacgcaaggctttcgccagcgtttgtataccgggtgcatgtaccccgtcatcattactcagcaatatgcgcataatcacctgttgtgttgataagttccctgacaacgctggttgcaaaactacccgccggaagccagaaacggatctctacggtgacgtcatcccaccaattccagcttaattgttgcggatacagcagcatcgctctgcgcgcggcttcaactttttcgcgcaccagtaaagcttgtaattcagtttctgcggcgacagctgcttgttcgaatgccagcgcttcacgctgagttccccattcgccactgcctggcaatgcggcggttatcatcaactctttatcgttgacgcgacgctgtaattccgccagttcttcggtggttgcgacaaaccagctaccacgtccggctaattgtagcgcatcgccgtcaacaacttgattaacgtctgcttttttgaggcgctcagcaacaatctgattaaacaacgcactgcgggctgccgacaaccaaaaactccgtttattgcgatcgcgcaccggagtattggtttgcgcccagcgctgcgccccctgcaagttgctaccgccaatcccaaaacgttgggcaccgaagtagttcggtacaccttttacgcaaatatcgatcagacgttgttcaacgtcatcgcgattgctcacttcgcgcagaaccagggtaaaggcgttacctttcagcgcgcctaaacgcagcttgcgcttgtgccgcgcatactccagcacctggcagccttccagttgaaaggcgctcagatcgggcatttccttgcccggcacgcgagcgcataaccactgttccgtaacagcatgtttgtctttttgcccagcgaagctgacttcacgggcatgaattttcaggaatttcgccagtgcatccgccacaaaacgggtattgcagccgtttttgaggattctaaccagaatatgctcaccttcaccatcaggctcaaagcccaaatcttccaccaccacaaagtcttccggattggctttcagcagcccggtgccttgcggtttaccgtggaggtaagtgagattatcaaactcaatcattttgttgccttaatgagtagcgccaccgcttcacaggcaatcccttccccacgtccggtaaatcccagtttttccgtagtagtggctttcacgttaacatcatccatatggcagccgagatcttcggcaataaacacgcgcatttgtggaatgtgcggcaacatcttcggtgcctgagcgatgatagtgacatcgacgttgccaagggtataacccttcgcctgaatacgacgccaggcttcgcgtagcagctcgcggctatcggcacctttaaatgccggatcggtatccgggaacagcttgccgatatcccccagcgccgccgcgccaagcaatgcatcggtcaacgcatggagcgccacgtcgccatcagaatgcgccagcaatcctttttcgtaaggaatgcgtacgccaccaatgataattgggccttcaccgccaaaggcatgtacgtcaaaaccgtgtccaattcgcattatgtattctcctgatggatggttcgggtgaggtaaaactcggccagtgccaaatcttccgggcgcgtgactttaatgttatccgcacggccttcgaccaactgaggatggaatccgcaatattccagcgccgaggcttcgtcggtaatagtcgcgccttcatttagagcgcgcgtcagacagtcatgtaacagctcacgagggaaaaattgcggcgtcagcgcgtgccataagccgttgcgatcaacggtatgagcaatggcatttttgcccggttcggcacgtttcatagtatcgcgcactggtgcggcgaggatcccccccgtgcggctggtttcgctcaacgccaacaatcgcgcgaggtcatcctgatgcaaacaaggacgagcggcgtcatgcaccaatacccactgcgcgtcgccagcggctttcagacctgccagcacggaatcggcacgctcatcaccgccatctacaacggtgatttgcggatgattcgccagaggaagttgtgcaaaacggctatcgccaggacttatggcaatgacgacacgtttcacccggggatgcgccagcagcgcatgcaccgagtgttcaagaatggtttgattaccgattgagagatattgcttaggacattccgtttgcattcgacggccaaatccggccgccggaaccacggcgcaaacatccaaatgagtggttgccatgttaattcccgggctgatttatcgattgttttgccccgcagactgtgcgcgcttcgacgcgtcaggcaccagacgataaaaagtttcgcccggcctggtcatgctgagttcattacgcgcacgctcttcgagcgcctcctggccgccattgagatcgtcaatttcggcaaaaagttgatcgtttcgcgctttaagtttcgcgtttgtagcttgctgtgccgccacatcatcattgacgcgggtatagtcatgtataccgttcttaccgaaccacagcgaatactgtagccagaccagaatagccagcaacagcagcgttagtttacccatcctgccccctgaaaaacggcatcatcatcccatgcatccgaagacgactctacatcctctgttggggataccgcgacaacgcgggcaaatgtaccacatttgtccattgttacgtatacccagggcgtgcagaacataatctcattattagttacggtttgaattatgaacagaggagacgggaaagtacaaattagcccagtagccacataaacagtgcgccaaacataatgcctactgtcaccagggtgaaaacaatactgtagcgtagctttccgtccatcaatgaatgcagcgcaatccccaccactaccgcgacgggcatcagcgccagaaagaaaggccaggtgtagataaagaagaacagcgtgttagagccataaatcaacatcggcatcgccagcgcaaataaccaggagataaaaccgaccacggcaccaggcagtgaccatgtggtttcttcatcctcagtaaggctgtcgttatttgttagtgtaatgttatggctattacgcatatttgatcctgttactttgacgaaccgggcatggaaacccggtggtgtctcaggatctgataatatcgttctgtctcaacagatctaataattgctgtaccaaatttgttactaattgttcaccattgagatgaatttctgccgattcaggcgcttcgtaaacggaatctattcccgtaaagttgcgcagttcaccggcacgcgctttcttatataagcctttgggatcgcgggcttcgcaaatcgccagcggcgtatcgacaaacacttcgataaagcgcccttctcctacgcgttcgcgaaccatctggcgttcggcgcggtgtggcgagataaatgcggtcagcaccaccagtccggcttcaaccatcaaattcgccacttcaccgacgcgacggatattctctttacgatcggcatcgctaaaaccgagatcgctgcataatccgtggcgaacattgtcgccatccagcagatacgtactgacgccgagtttatgtaacgcctcctccagcgccccggcgaccgttgatttaccggacccggagaggccggtaaaccacagcactacaccacgatgaccgtggtgtagctcgcgttgttgcacagtgaccggatggctatgccagacgacgttttcgtcatgcagcgccattatttatcccccagcaaatcgcgcgcgccccagtgcggaaagtggcgacgaaccagagcattcaattccagttcgaatgcactgaattcagatggcgcagcagttgcctggctaactggctcgtgcaccataccggcacccacggtcacattgctcaggcgatcgataaaaatcagcccacccgtcaccggattttgttgataacgatctaacaccagcggctcgtcaaaagtgagatccacgaggccgatcccattcagtggcaggttttcaacttcacgctgggtaaggttattaatatcaacctgatagcgaatgccatcaacacgcgcgcgcgtcttcttaccggcaattttgatgtcgtaactctgccctggagaaagcggctgttccgccatccataccacatccaccgacgcgctctgcaccgccggtaacgcttcgtctgccgccagcagcagatcgccacggctgatgtcgatctcatccgtcagcaccagggtgatcgcttctccggcaaaggcttcttcgcgatcaccatcaaaagtcacgatccgcgcgacgtttgattccacaccagagggcagcactttgacacgttgcccgacttccacgcgaccggatgccagcgttccggcgtaaccacgaaaatcgagattcgggcgattaacgtactgcaccgggaagcgcattggctgagcatccaccactcgctggatctccacggtttccagcacttcgagcagtgtcggaccgctgtaccacggcatactttcactttgcgatgccacgttgtcgccttccagtgcagagagcggcacaaagcggatatccagattacccggcagctgcccggcaaaggtcaaataatcttcacgaatacgggtgaacgtctcttcactgtaatccaccagatccattttgttgatcgccacgaccagatgtttgatccccaacagtgtggagataaaactgtgacgacgggtttgatcgagcacgcctttacgggcatcgatcagtaagatcgccagttcacatgtcgatgcgccagtcgccatattgcgggtgtactgctcgtgccctggggtgtcggcgataataaatttacgcttctcggtagagaaatagcggtaggccacgtcaatggtgatgccctgttcgcgctcagcttgcaggccgtccaccagcagagccagatccagcttttcgccctgggtgccgtgacgcttactgtcgttatgcagcgatgagagctgatcttcgtagatttggcgggtatcgtgcagcagacgaccaatcagagtacttttgccgtcatcgacgctaccacaggtcagaaaacgcagcaggcttttatgttgttgcgcaatcatccaggcttcgacgccgccttcattggcgatttgttgtgcaagtgcggtgttcatcttaaaaatacccctgacgttttttcagctccatagaccccgcctggtcgcggtcaatcacgcggccctgacgttcactggtggtggaaaccagcatctcttcgatgatttccggcagtgtttgtgcatttgactccaccgcaccggtcagcggccagcagcccagcgtacggaaacgcaccatccgttttttaatcacttcgcccggttgcaggtcgatacggttgtcatcaatcatcatcaacataccgtcgcgttccagaaccggacgttccgcagcgagatatagcggaacaatgtcgatattttccagccagatgtattgccagatatcctgctcggtccagttagagagcgggaagacgcggatgctttcgcctttgttaatttgcccgttgtagttgtgccacagctccgggcgctgatttttcggatcccagcgatggaagcggtcacggaaagagtaaattcgctctttagcgcgggatttctcttcgtcacggcgcgcaccaccgaaggcggcatcaaaaccgtatttgttcagcgcctgtttcaggccttcagttttcataatatcggtatgtttcgcgctgccgtgcacgaatggattaatccccatcgccacgccttccgggtttttatgcaccagcagttcgcagccgtaggctttagcagtacgatcgcggaactcatacatctcgcggaatttccagccggtatcgacatgcagcaacgggaaaggcagcgtacctggataaaacgccttgcgcgccagatgcagcatgacgctggaatctttaccgatagagtagagcatcaccggatttgagaattctgccgccacctcgcgaataatgtggatgctttccgcctccagttgccgcaggtgagtaagtcgtatttgatccataaccgttcctttgcaataccgctattttcttgccatcagatgtttcgactatagggagcgtaagagaacgaatgaaattaccaattagaatgagtagttccttaacggaataacgatttggcaaagctaatatcaaaaagtgcttaaggcaccggatttcgggcgtttaggaagatttgaaattgttttagcgcagcggcagtttcatactatggcggtaaaaaaatttgcatggtatttaaggactcactatgttttccgcattgcgccaccgtaccgctgccctggcgctcggcgtatgctttattctccccgtacacgcctcgtcacctaaacctggcgattttgctaatactcaggcacgacatattgctactttctttccgggacgcatgaccggaactcctgcagaaatgttatctgccgattatattcgccaacagtttcagcaaatgggttatcgcagtgatattcggacatttaatagtcggtatatttataccgcccgcgataatcgtaagagctggcataacgtgacgggaagtacggtgattgccgctcatgaaggcaaagcgccgcagcagatcatcattatggcgcatctggatacttacgccccgctgagcgatgctgacgccgatgccaatctcggcgggctgacgttacaaggaatggatgataacgccgcaggtttaggtgtcatgctggaattggcagaacgcctgaaaaatacgcctaccgagtatggtattcgatttgtggcgaccagcggcgaagaggaagggaaattaggcgctgagaatttactcaagcggatgagtgacaccgaaaagaaaaatacgctgctggtgattaatctcgataacttaattgttggcgataaattgtatttcaacagcggtgtaaaaacccctgaggcagtaaggaaattaacgcgcgacagggcgctggcaattgcgcgcagtcacggaatagccgcaacgaccaatccgggtttgaataaaaattatccgaaaggcactgggtgttgtaatgacgcagaaatattcgacaaagcgggcattgctgtactttcggtggaagcgactaactggaatcttgggaataaggatggttatcagcaacgcgcaaaaacacctgccttcccggcgggaaatagctggcatgacgtaagactggataatcaccaacatattgataaggctcttcctggaagaatagaacgtcgctgccgtgacgttatgcggataatgctacctctggtgaaggagttggcgaaggcgtcttgatgggtttgaaaatgggagctgggagttctaccgcagaggcgggggaactccaagtgatatccatcatcgcatccagtgcgcccggtttatccccgctgatgcggggaacaccagcgtcaggcgtgaaatctcaccgtcgttgccggtttatccctgctggcgcggggaactctcggttcaggcgttgcaaacctggctaccgggcggtttatccccgctaacgcggggaactcgtagtccatcattccacctatgtctgaactcccggtttatccccgctggcgcggggaactcccgggggataatgtttacggtcatgcgccccccggtttatccccgctggcgcggggaactctgggcggcttgccttgcagccagctccagcagcggtttatccccgctggcgcggggaactcaagctggctggcaatctctttcggggtgagtccggtttatccccgctggcgcggggaactctagtttccgtatctccggatttataaagctgacggtttatccccgctggcgcggggaactcgcaggcggcgacgcgcagggtatgcgcgattcgcggtttatccccgctggcgcggggaactcgcgaccgctcagaaattccagacccgatccaaacggtttatccccgctggcgcggggaactctcaacattatcaattacaaccgacagggagcccggtttatccccgctggcgcggggaactcagcgtgttcggcatcacctttggcttcggctgcggtttatccccgctggcgcggggaactctgcgtgagcgtatcgccgcgcgtctgcgaaagcggtttatccccgctggcgcggggaactctctaaaagtatacatttgttcttaaagcattttttcccataaaaacaacccaccaaccttaatgtaacatttccttattattaaagatcagctaattctttgttttcaaacaggtaaaaaagacaccaaccttaaaccatccaaatctaccggggtacgcctgtttaacccaaatgtctggaactcaaatcccgtttccgtattcgttgcccatgccatcactacattgccttcttccgccagtccagctatttgttcccagatcatttcacgaatttttgcggatacatcacctacatatacccctgcacgtacctccaacaaccagatggctaatctgcctcgtaagcgcggaggtacattttcagtgaccacgaccaacatactcatttcagctactccgatggcctgcatctcccagtgaaacaggaagcggaatggcaacaggctgtgcatcttcaggtggggccggcggttgtatttctccagcggcaagcacgtcctctataagcggaatcaatttggctaatgttttactactgcgaaaaatatccctgcacgccaaacggacttcccggtccggctcaccagggttacgacgcgctatctcaaaagctttcggtacaacagtgtcaaatttaatgatgtctgcaatatcgtaaacaaaggaaagaggctttcctgtatgcacaaacccaatagctggtgcataaccagctgcaagtatcgccgcttcagttacgccgtataaacaggaagttgcagcgctaatgcattggttgatcgtatcgcccttttcccagtctttcggatcgtagcgacgtccattccatgtcacgccgtattgcttcgccagaagtgcgtaggttgcccgcacgcgactgccttctatacctctgagttgctctacggagcgccgggcaggcgcaggttctccaaaccgaagttcaaacattttacgtacgaccttcagacgcaaatcttcatccagagcaagttttgcctgatagagcagcttatctgaacgcgcacctccaggctgaccagaagcataaacacgaacgcccgcttcccccacccataccaacaatgttccaacttgcgcagccaggcgtacagctgcatgcgaaacccgtgtaccaggttccagcatgatgcaggcaaccgagccaacaggaatatgagtgcggatccctgtcttgtcgataagtacaaacgcgccatctattacatcgatctgcccatattgcagaaagatcatggagacgcgatctttgagtggaatgggattaaggggaagccaggtcattttattacacctcaatcacagtggagccaaagatagcaagccacatcccatcgatttagctggcccaataccttgctgtacaagatctattaacgctggcgcgtcgttgatggtgagcacaccttcaaagcaaaccgtttggatctttccacttttaccatcaccagaaaaatactgtggccgttccgatatgggatgcacatcttcaacgcgcgccgcattgcccaatttacgttgcaaccacgcgatttgttctgcttcttttattaacggaacccgacagcgtttaatattccctttactgtccaggcgcttttgattgtcgagaatagttttgatcggatttgcccgaagccgaaaatagagtggaacaccaacctgaagttgaaattcaacctgtttagttttaatgactgtcgcaacggcagttgaaacaggcatttgcgctgactgcaataaaacatgacagccttctggtgtgtttcgcttctcaacatgaaaaagaaaatcacgagcagcatccggtctgtttggaaataaatgccataatccctggtgaagttggtaaagatccctgctccaggccctggcaatgatgactttactgagatacatccatacctcctttaatcacataccattctcgggaagcaaattgtcgaggcaaggtgatcatcggttcgtcgcgcgccgtaaattttaaatgatgccctgtaactgattcctcactatatatatcgccgccaacgggctcataatttaatagcgccttctgaggatccgatgcctgacatgtccccaaaaaaagcgggtgtgttagtgggcaacttctccgccccaggtaaggtgtataccgaggctttaatactgctttttcaagttctgagataaccatcgttgcatggggtgttaaccagagagcgacggtaaaggaggcatcacataaatattcgcgccatgtttgaatcgtttcatgacttttcaaaccacggtaatcttctcgcgctccaaggactgtatggtaatcacgcaaccccgttacagacacacgacgatcgtcaagaatgagttcatcgcagcgcactgcaaattgcacactctctgataacgcctgtaatgaagaagtatcatcacgttggatcccaagacaagccccgagtagccctaataacccgcttcgggtcggaaatcttccggtaggtcgcgttccttcaaaggtcggctgcccccaggcttgcattggcccagcaagccgcaagatcaaataagatctcatgttcacgcctcgccattattacgaacccaggattttaactgttctaaagtaggcatttgtttaacttgagcagtaattgggtctacatcagataagctgaattgcgcagcagctccgttcagaccatatccattggcaacgcgatcccaatattgattaaacgcctgtatagacggttgcaaaaagccatctttcgctttaaccgctttttcaaaagcatttgccatagaaagtggcatatcggagaaattaaccattaccatatccgcagggttaaaagcggcataagtacgctgttttgctccagggacctctgttgccagcatatgaacaacatgggttgcaatttccagagcctgctccctggaggcaccacctaaattttcctgaagttgagcgaggttaatgttggcataacgataaaaaacacccgatgaaaattcctgagttcccagatgtgcagaaccttgttcctgtaaatcatctacagcggtgaaccagtcaatatcagaatcaacctgatgagtagtgatcgcatgcgcaatggacattgcaccatcaacttttcccaactcagtcatcatgccgctggttgccattcttccactaagcgcaatatcaacaccctgctgtaaattcacacgtatggcggcaatatcttccttaagaactttgagcagctttttatcatccagattatcagcctctgcttttgcaacctgctcacagaaccaggctatttctcccacaacccagggagtaaccgcatcggcagaaatcttttcggcttcatcaactgatttaccggagagcagcgctaatgtcttatcgatgattttttggtcaaaacgttcaccaagtttttgccgaagaacatcacgtaattgtgcaagatgaatggttctgagactggattcaccaatattttgtgcgtaataaccacttttacgcatcgcacgtttaaggctttgacttgaaattcttactcgtcttttgccgccgaaaatagcgtctttctgcatgttcatatcgtcgcggttcagacatgaagggctgtgagagatcagaacatgaatattgataaagttagacatagaaaggtttccttacgcatttttgtttgtggtcaatacaaaatcttccagaagttgctggcgttcgcgctttccccaccaggtcaacatcctggccattaatggccagtcaagtacgggttcggcgtgagtaagtaatcgacgtaactggaccatatcggctgttctgtcagcccgaattaattgaaagatacggcgctcgttaattcttccactattggctaaagctcttcccaacgagatacctgttgtttgctccgattttttgtcctgatgtcggatgacattctttcctgcgctcaggcaaaacaccatgcgcaaaagagcctgctggtgacgtgggttttcccaaccaaaaggttgcaccagcctataaaacgcagggatatcgcgtaattcatcaggttctgaaacacgtctaatttgcgcacatgatccattatccagttgttgccaggctcgatataaagccattgcatcaatttcatcagccatttgatggccctccttgcggttttaactcccgtaaatgtttgtatagcgtggcgcgggcaagcgctaatgtgcttattaatttaggatgatgtgcatagggagctacagattgattaaatagcatttcacacaattgatgaagtttgtctcgtaaatcagctattacctcatcagcctgggaaaaattaacattcgccagtacatcgggaattaataattcactctgtcgatagaaatgcctttctgcagtctcatgaacagagactccggcccctttgaagtctttatttttaaacccttctgcaaaggtatataacgccttgcgtaaggctgttttatatcccaaaccaacagtcactatttcgtttatcacattgccgtattgttgccacccctgattaaacatcaacacatcatgacgccgttcaagaatagatgcttgattattacgatatccccccataatcaattcaagaggactttgcggcgcaatatttctgaattgattcacaaccgccgccacgcgatttccattttcattttgaataatcttatctaccacaactcggctgatttgtgtccatgatggtgcggaggtggtgaaagcaagaaatttttcctcaacctcccctttcttgactgttaccagacaaggggaatgcggatggggccatagcccattaactgtaaaggtaaatttttccttaagaaaaccggtataacgcaaattgctttcctgtccacagcaagaacatttaccaatcccaatgggatcgcataattcaatatgcgctggttgccagaatagaccacggacaaacccaattgacgaagcaggtatagactcattggacttgataggtttaatccaggtaggttggttttccgtatgtgattcattaggaaattgtttttgaagacgaggtaatgtgaggacattgagtaacaccgttgaacgaagatcgatcccacgtacgaacgttgttacaggtgttcctccacgtaaaccgcttttaaaaccaccaccaaaacctggtgcctgattcgcctggttgaataacgcaatcgcagtgcatccaccacataatgcttcaccctgccccggttgattgacaaatgcacaattcgtcgcgccgcttaccccagccaacagtttttccattggagtcacatcatttgctttgacacctttggtctgcataaagggatgttctgcgtgattaaggtagaacatatctatccacggcgcgatgagttgttgaaactcatcttcagtgagcggattcattatgcgatgtcgaaattcaacgtcatcttttgccggggcgataatttgcccaatgcaaaccagcagtgctaaagcggccagttccatatcgtcacggggcaaacttaatcgccactgatctctactgcagtatagcgattgcagatttatgatttggactttccccccgtttcgcgggcgtacagggatccagttatcaataagcaaattcatttgttctccttcatatgctccgacatttctcctgcatttctatacgtcggcacacttccgttatcggtaaaaacaaagaaaaaatacggcgtaattaattcaataatcacattcactgcaaaaatatattcattggtttaatacaattaacctatacatatattaagatgtgttgaattgtttaaagacaataatgcatgcatttcaaatctgcaagttattcgttttattattaaagaaacttttagttataataattaccatgaattttattacataaaatattcatactgtgaatataaaatctcataccgggaaattaaaagaagatgtacattgtgcaccttccctacttaagtagggataaaccgttattggtcttattatcgtcattgataacaatcattcccgaagttatttgggatttgcagggatgactctggtcatcccttcatcccctgtataggtaataacaatactgttaccctgccagacccatccatccagattctgtttcccttccagccaaagtaacccatcttcatctactacttcagaaaaactacgtttccaggtgaagggtacattgacgcgattaagtgcaagcgcctcatactgctgttcatgacttaggtcctcgtagacctggccatcgagcagttgtttacctgaagacgtttgtacataaggcaataatggcaggctcatttccccatccctcgttaccgcaagaatggtttcatcgttatcctgcaagctatattcttcagcccactgcaggaccttgcgagccttgaaccttttttcacactcggcgctttcaaatttatccatgccattgccgacccattctggctcatccatttccgcatcatcgtaaatgctatccagccattgccggtaagcatcagggaaaaataaggatgctccattaagctcctcaatatgttgctgcgtccgccacatgactctaacgttgctataaatatgctcatgtcgtccgtaaccctcgccatcaggcagcaaaatggtggcaacaggaatctcaaaaccagcgggacgatatttgcgatgatggcgatgtaaacggcccaatcgttggaaaagcaaatctgcaggacaatgctgagtaattaaccaatcaaaatcaacgtcgagtgattgttccacgacctgggttgcgacaagtatccgtccaacatttcgcttcccatttttgccgaaattgctaataactcgattctctttttcacgacgatcgttcagcgtaaagcgcgcatgaaacaaatctatatctacttgcgtgttatttagctcctttagccgttggtagcatacttgtgcaacgtcaaccaaattgcaaataagacagacctgtgcacccgcgtttgccgctgcgatcattcgctctaacatcgtaaggtcaggtaacatgtcagctaaacaaataggttctggctgaatcgaaaagcggggcgggagttgttctggatgagctagcagatcaaaacgttgcgcaccattcacacctcgccagttaatgagtggatatgcggagttattttccactggatctgtatgcagaccataagtatccagaagtttctgtttttgtttcattggtagggttgcggaaagaagaataacactccctcccacatcagcctgagccttgagcactgcctccagcaagccgttcatataggtgtcgtaagcatgaacttcatcaacaattaaaacacttcgaccaattcccaaaccacggataaagcggtgtttaactggcaataccgatatcaacacctgatcaatcgtgcaaacgccgatttgcccaagaaacactttcttattgctttgtgacaaccactgacaacactgaacccacgcttcttcttgcccctgttcagtaatcgcgcgtgattttattgattgaaagaggtggttaaaccgtgaattgccatgagcaagaataagatttggggatgaaaataagtggctcgcgctcgcttccattctcgtaagcatagcattcgcggtagcttgtgttgggagggcaaaaataacactatccgcaatttgttgatcaataagtttccaagcataggccagcgctgtttccgttttaccggagcctgtaggtgcctctattaccgtcagcccgggagctactggaagagcatcaactaacacctgtaattgtctgggttgatagccattgtccagtagtgcatgaacaccttcataacatcgcttatttgatacaagtccactcaactccaatacccggctcgcatcctgctgtcggtcctggaaatacgttctcagagcatttatgtcggaaggcgcatcctcattaaacagaaaggtattcgttgtagtccaggagcctaaccagtcagcaagcgagcaaaaacctgctaacagtgatgaacaatcaggtggtatatcgtttatagataaccccgctggcgttaaaaataatgcttccagtacagatatccactcctcacgagcctgtttatcttgcgcagcataagatgccagagaagctggcatttcccaacgcgacttatcttgatcctgggaatgtaatataaaaccatgatgtcctgtaacggcctctacccatggaaaccaggactcataaggatgaggagcggcatcaaaaaaactgaaaaaatccccgagagattgctctgaaagtgaatcctggttaaaccaatacagaccggctgcaccatgattaaatttacggcacatttgtgttgatggaccattaagtgatggcgttgcaggatttaatttcagccaactttctgctgatttatattggaatcgtatatcaaactttccaatatcatgaagagcaatgaaaaataacagccaggccttcaccctctgttttgatagcatttcatttcggcaaaaagtattttgcagtacgactgattgatcccaccagcaatctgcaacagcagcaacatcaaggcaatgataaattaacagatgaatatcatttcctttcgtcaagctttttgaggattttccccagtaatggcatatatatttaaaaggttccattaatagcctccctgtttttttagtattatcgatgatatcagcgggctatttttcgatgctgctcataaatatcgaattacagtgatatacacatgtcttgcctccctgcaaagaagagactaacattcgaattgtttgggttcgaacgctggcctcaggttgatagaaatatcgcctggggcttttgtccatctggaacctcgcgaatgcttaacgccagacagcctcaagcacccgacgccattctatacctgataattcttcccgcggcgttcacgtttaaaatcaggaatgctgctcgcaaaataaaaacgcccccatcatttctgacagaggcgtttaatttgtccggcaatatttacccttcgtgtaacccacattccctttttaagccaaagaaacgcgtttcttcttccgccatgccgggttcccatttacgggttgtatgggtatcgcccaccgataaatatccttcatcccataatgggtgatatttcaggccatgtttttgcaggtactgataaatagttcggttatcccagtcgataatcggcagcactttaaatacgccacgctgaattgccagcaccggtaaattggcacgactgccggattgttcacggcgcaggccagcaaaccaggtttgcgcattcagttctttcagagcccggttcatcggttcgactttgttgatgtcattgtacttttcaatgccttcaacgccctgctcccacagttttccgtagcgtgcttcctgccaggctgcgctttcggtagcacggtacactttcaggttgagcttgagtttgtccgttaactcgtcaataaagcggtaggtttccgggaacaagtaacccgtatcggtgaggatcaccggaatatccgggcgaatttgattcaccagatgcaggctcaccgccgcctgaatgccaaagctggaagaaagtacatattcaccgggcagattatccagcgcccaggctacgcggccttcagcgtccagtttttccagttcggcgttagtttccgccagcgccagaatgcgatctaccttcggcagttcgttcagggcgtttagatcgagtttggacatagattcctcactgtttgccttgcctgatgcgacgctcacgcgttcttatcaggcctacaagaccgggctgatggttaatcccacaaatcacgcgccggatcgagcaccgggcgaatgatgcccgcacgcaccgtaaagtcgccgaagccttcacccgcttcgcgctctttcgcccagcgccctatcagttcatcaagcgacgccaggatttccggctcggtgatgttttctttatacatccgtgggatacgtgtcccaatgcggttgccgccaagatgcaggttgtagcgacccggcgctttacccaccaggcccacttccgccagcatcgcgcgaccacaaccgttcgggcagcctgttacacgcatcacgatatgctcatcgctgacaccatgtttcgccattaaattatcgatgttgtcgataaaagacggcaggaaacgctctgcttccgccatcgccagcgggcaagtcgggaatgacacgcaagccatcgagttttcacgctgcggcgtgacggcattcattaacccgctctctttggcgatcttctcgatcttcgctttctcgctttccggtacaccggcgatgatcagattctggttcgccgtaatgcggaaatcgcctttgtggatcttcgcgatctccagcaggccggttttcagcggacgcgccggataatcaaggatgcgaccattttcgataaacagcgtcaggtgccagttatcatcaatgcccttaacccagccaatacgatcgcctcgtccggtgaactcatatggacggatcggttcaaatttgatccccgcgcgacgctccacttccgctttaaacgtctcaacccccacgcgctccagcgtgtatttggttttggcatttttacgatcggttcggttaccccagtcacgctgagttgtcacgacggcttcggccaccgccagcgtatgctccagcggcagatagccaaactcactcgcggtgcgggcgtaggttttcttgttgccgtgttcgatggaaagcccaccgcccaccaacaggttaaagcccaccagcttgccgttttcggcgatcgccacgaagttcatgtcgttggcgtgcagatcgatatcgttctgtggcgggatcactaccgtggttttgaatttacgcggcaggtaggtctggccgaggatcggttcttcatcagtagtggcgactttttcctggtcgagccagatctccgcatacgcgcgggtacgaggcaacagatgctcagaaatcttcttcgcccactcgtacgcttccgcgtgcagctgcgactcgtaagggttcgaggtgcagagtacgttacggttcatgtcgttagctgtcgccagcgcatcaagaccgaccgagtgcagcatctggtgcaccggtttgacgttctttttcagaatgccgtggaactgaaacgtctggcggttggtcaggcgaatgctgccatagatggtgttttcaccggcaaatttgtcgatcgcctgccactgtttagtggtaatcaccccacccggcagacgacagcgaagcagcatcgcgtggcgcggctccagcttctgttcagcacgttcggcgcggatgtcgcggtcatcctgctgatacatgccgtggaagcgaatcagcaggaagttgtcgcccttaaagccgccggtcagaccgtcgtttaaatcttccgcaatggtgccgcgcaggtagttgctttcatgcttcatgcgctcggcgtctgtcagttttccttcgaccactaaaggccctggatgtttttcgctcattagtagacatctcgctgataacggcgctctacgcgcagctcacttaaaaattcatccgccgcttcggtgtccatgccaccaaattcggcaatcacttccagaagtgcctgctcaacgtctttcgccatgcgattagcgtcgccgcagacataaatgtgggcaccatcattgatccagcgccacagctccgcgccctgttcgcgcagtttgtcttgtacgtaaactttttctttttgatcgcgcgaccaggcaagatcgatacgtgtcagcacgccatctttgacgtagcgctgccactccacctggtacaggaagtcttccgtaaagtgcggattaccaaagaacagccagtttttacctggcgcttcgtcggcggcgcgttgctgcataaaggcgcggaacggcgcaataccggtgcctgggccaatcataatcaccggggtttctggattggctggcaggcggaagttatcgttatgttcgataaatacgcggacttcgccctcttcttccacgcggtcagcgaggaagctggaggcaccaccggcacgggcgcggccttccacgtcgtaacgcaccacaccaacggtgacgtgtacttcgttctcgacttccgcctgcgaggaggcgatggaatacagacgcggcgtcagcgggcgcagcagattaattagcgcttcggcatcaagctgtgccggggagaaacgcaccatgtcaacaatcggcgtcgtcgcggcgtaatgctgtaacttcgctttatcgcccaccagcggcagcagtgtttcactgcgggtaagcgtggcgtaattctcaacaatgttggcggtgttgacggtcagttcgaagtgccactgtagcgcttcgttcagaggcaacgttttgccctcgacggtgacaggttcatcgcctttcagccacagcagttcgacaagttctttcaccagtgccggatcgttctgataccagacgcccagcgcgtcacccggctggtaacgcatgcccgagtcacctaagtcaatttcgatatggcgaacgtctttttcagagttacgcccggtaattttctggttaacagagaggctagccaccagcggcgcgtctttgctgtacgggctggtgtggatttcatttaccgcgccagtagcgacggattgcgaaggtgccgcgacaggcgcacgcgatttaagcgcatcaaccacgcgggcgcgccactcgctggcagcagcctggtattcaacatcggcatcgacacggtcgagcaggcgttcaccacccagttccgccagcttgctgtcgaaatctttcccggactggcagaaaaattcataagagctatcgccgaggctaaacacggcaaacgcggtgttttccagctttggcgcttttttggagaacaggaacttatgcagcgcgacggcttcttccggcggttccccttccccttgcgttgacgtcactacgatgagcagtttttcgctggcgatttgtttgaatttatagtcgcccgcgttcaccagcttaacgttcagttttgctgctaataaatcatcacgtaatgcttcagcaacccggcgcgcattgccggtttgcgaggcggagataatagttatacccggcatttctgcggctggcgctggcgtcgctgcaagcgcagcaggctgctgattgagtacgccccagaaatagccagaaacccaggcaagctgggtgggagttaaatcggtcgtggccgcctgaaggcgtgccagttgctccgggttcaacggaagcaacgcggaaggtgggacctgtgtcgtcatgcgtcgttatgttccagtaagcaaagctgtttctgcgccctgtcagcgcccataaaacagaagagaaggtaaggttaacggggcaaacggtgtggattaaagacgggatagcgataactaataaccaaatcgactaacctgttttagcaatagtctttaacaacaaaatagattaaccaacctaatgaaaaacaaatgaatttagccaatcattaagataaatcagcgattttgcgcaacaaagtcgttttagataatgcgaaaaaacagcctttccggtactctacggcggttttatcgtcctgtagagaaattatgatgtccaccacgttatttaaagatttcaccttcgaagccgctcaccgcttaccacacgtcccggaagggcataaatgtggtcgcctgcacgggcattcctttatggtgcgactggaaattaccggggaagtcgatccgcatacgggctggattatcgatttcgctgaactaaaagcggcgtttaaaccaacctacgagcgcctcgatcaccattatctcaatgatattccaggtctggaaaacccaaccagcgaggttttagcaaaatggatttgggatcaggttaaacccgttgtgccgctgttaagtgcggtgatggtaaaagaaacctgcaccgcaggttgtatctatcgcggcgaatgataagagtgtgtcggcggtcaatttcccttaagtaacgctatgttagggtgttgtgttctggatatctggggcatgacatggaagacgactgcgacattattattattggtgccggtattgcaggcaccgcttgcgcgttacgctgcgcgcgagcgggtttatccgttttgttactggaacgcgctgaaatccccggcagcaaaaatctttccggcgggcggttatatacccatgcactcgcggaactcctcccgcaatttcatctgaccgcgcctcttgaacgacgcatcactcacgaaagcctttccctgttaacgcccgatggcgtaacgacgttttccagcttacagcccggcggtgaatcctggagtgtattacgtgcacgattcgatccgtggctggttgccgaagccgaaaaagaaggtgtcgaatgcatccccggagcgacggtggatgcactgtatgaagaaaacggcagagtctgtggcgttatttgtggtgacgatattctccgcgcccgttatgtggtgctggcagaaggtgccaacagcgtcctggctgaacgtcacgggttagtgactcgtcctgctggcgaagcgatggcgttggggatcaaagaagtgctgtcgctggaaacatccgctattgaagaacgttttcatctggagaataacgaaggcgcagcgttgctgttcagcggcaggatctgtgatgacttacccggcggcgcatttctttatactaatcaacaaacgctctcgttagggattgtttgcccgctctcttcccttacgcaaagtcgtgttccggcaagcgagctgctgactcgctttaaagcgcatccggcagtgcgcccgcttatcaaaaacacggaatcactggagtatggtgcgcatctggtgccagaaggtggcttgcacagtatgccggtgcaatacgccggtaacggctggctgctggtgggcgatgcgttgcgcagttgcgtcaataccggaatttccgtgcgcggcatggatatggcgctgactggcgcgcaggcggcggcacaaacgctgataagcgcctgccagcaccgcgagccgcaaaatctgtttccgctttatcatcacaacgtagagcgcagcctgctgtgggatgttctacagcgttatcagcatgttccggcgcttttgcaacgcccgggatggtaccgtacgtggcctgcgttaatgcaggatatttcccgcgatttatgggatcagggtgataaacctgttccaccgctgcgccagttattctggcatcatttacgtcgtcacggcctgtggcatctggcgggcgatgttatcaggagtctgcgatgtctgtagcccgtaatctctggcgcgttgctgatgcgccgcacattgttccggctgactccgttgagcgccagacggcagaacggttgattaacgcctgtccggcaggtcttttttcgctcacaccggaaggtaacttacgtattgactatcgcagttgcctggagtgtggcacctgccgtttgctgtgcgacgaatcaacactacaacagtggcgctatccgccttccggattcggcatcacctaccgctttggataaataataaggataatttatgcccctcttacacctgctccgccagaatccggtgattgctgccgttaaagataatgccagcctgcaactggcaatcgattctgaatgccaatttatttccgtgttgtacggcaatatctgcaccatcagtaatatcgttaaaaagattaagaacgccgggaaatatgcttttattcatgttgatttgctggaaggcgcgtcaaataaagaagtcgttattcagtttttgaaactggtgaccgaggcggacggcattatcagtaccaaagcctcaatgttgaaagcggcaagagcggaaggttttttctgtattcatcgcctgtttattgttgattcaatttcgtttcacaacattgataagcaagttgcgcaatcgaatccggattgtattgagatcctgccaggctgtatgcccaaagtgctgggctgggtgacagagaaaatccgccaaccgctgattgccggtgggctggtgtgcgatgaagaagatgcgcgtaatgcgattaacgcgggtgtcgtggcgctttccaccacgaataccggggtctggacgttagcgaaaaaattactttgacgggataatcgtaaccaattgaatttggtttgatttgtaggccgcacgccacatccgacattcagcgcctgatgcgacgcttgacgcgtcttatcaggcctacaagtccccaggccagaaccgtaggcaggatcatccggcaacacgttattggcaatctgcgtgaatgtttgtcaccagtgcctccagcaccactttccagtcatcaaccacgccaacatctgcctgtgaaaataccgcagcgctggcgtcatgattaatcgccaccacaaacttgctattgcgtacgcccgccattaacgctgctgcgccagaagcgccaacaacaatacacacctcaggtgccagcagatgtccggaaataccaatcactttttcagcatcaacgccaccgttcatcactcgcgcccgactgtagcccacttcggctcccagcttttctgccagcatagcgatttcctggttatctgcctctccgccctgccccaccaccagcacccgtctggcctcagctaatgggtcgcgggtaacatttttcagatcctctgtgctaaccagccagtccggaagcgcacccgggacaatgttcagttgttgcattccagagggcaacgtggcgtttttcgctgctcccgcctgacgcgccagggaaaggcatagcgggcgtttttctgtttgcagcgtcgccgttagcgcatttccccagtgggatttgcgcacgcttacggttggaatatctaacgaagtcacctggcagatgcttgcaccatgtaaacgccaggccagccgggtcgacagttcatcgccaaacgttcccggcggaaagagaacaacgtccgcaggcgttcgctgccactgttccaccaacgcatccagcacctgttccgccactacaggctgaggttcaatctgccagtgcgccagggtacaaccgctgaaatcctgcgccgccagccagcttgctattgcggcattctcctgatttattgtcacaattgcgatattcatggctgcatcctttggcgtaaatagtcctgccatagcttttgagctttttctgctaccgtttgcccatcaatcagcgtcgctccgcgtcgttgctctgctcttgccagttgcagacactgcatcgctggcatttcggcagcaacagttttacggataatttctgctttccccgcagccattcgctggcgcattcccggtactggcaaggccacttcaccgcactgacgcacggcaatcaccgcaggcaagcgaacccggcaacaacgcaacccatgttcagtacgctgttcgagggtgataaacagcgcgtcgagagtgaaacgctccacctgggtgaagcagggccagcccagcatttccgccagcaaaaatggcgtttgcccattctgcccttcgctgctttggcagccggtaattatcagatccagcggattctgatgctgccattcggcaatatggcgagcgacaaattccggcgcaaagcgcagatctgccgccgtctccagcaatacagcttcctcaaacccaagagccatgagatagcgcagccagtgcaatgcccgttcatcccccatgctcaacgcggttaaagacatcggcgtaccgttttttctctgcgccaacagcagcgcggcagcggcctgttcatcagcaccgagtaaacttcgcagtagcgaaatatccggtccgcttttaccctgagccgccgcctgccactctttttccgccagcattccggcatccggttcggctttaaacgctaacagaatgttcattcgcacctcctacatttcccgccgccaccagcgggagggctttagtttctggtgcccatagccaggtcacaacaaaaccaaccaacaacactgtcgccaggagcaataaggtgacttgcattccccactgcgccagcacccacggcagcaggccagtacttaccgccgcgccaagtcgactcatggcagtggcaaaaccgacgcccagcgagcgaatgtcagtaggaaaactttccgcaggcaaaatgcccaccagattactgactgccgaaatggtggtgctgaagagaacaaaaagcagcagcgttaatgaactgccggaaggcaaacaggccatgactaccagcgttgccgccagcagcaaaaaacttcccagcaaaaatttgcgatgtgccagcaggtgcgtcagaactaatcccagcagcgcgcccacaattaacaacgcattaagcatcaggctggcagtcagcgcatcttccagaccaatagtctgggcgatagttggcagccaggtataaatcacaaaccatgggattacgaggcagacaaagaagacgctgttaaacgccgtgcgccgccagtaacgcgaagagaacaaggttttgatgtgtttatgggtcgccgttaccacttcatcgcccagtaaaacatggggaccaaaatagcgatgcacgatagcgtgagcttctgcaaaacgcccctggcgcagtagccagcgtggtgattctggcgttccccagcgtaataacgtaatcaacaacgcgggcagagctgccgatgccagtagccagcgccaggcctccgggttttcggaaataaagtgatgtccggcaatacttgccagcacatagcctacggtccacaccacgctgaatgcgcccagcaaaataccgcgatggcggcgcggggaaaattcagccagcaaggtgtgacctactgaataatcgcctcccagaccaatgccaatcaaaatgcgcagtccaataagatgctctggcgtggtggcaaaaaattgtaaaaacgaagcaagcgtaatcagcaaaaagctgaaggtgaagattttttgccgaccaatatggtcggagatccacccaagaaccaggctgccaaggaacaaaccaaggagcgccgagccgccgatcattcccgccataaacggcgtcagttgcatggcgggcgtaagctgaataatggcgtaaccaatgacgccgagaacataaccgtcggtcaggtgtgcgccgaaagtgagcgcagcaatgcggcagtgaaaacggttaagcggtaaatcatccattcgcaccggtgaagtgttcatctttaccccttcattgtccggtaataagaacggcttctcgcctgagaagccgaaaaggcaacgccccgtcatcgcggaacgctgcctgacacattatttttcaatcggatagatagtacccgtattcataatgccattaggatcgaactgctttttcagcccttccagcaacgcccacgcgctgccgtgttccagtttgctccagtgaacgcgatgtttaccgataccgtggtggtgcaccatcgaaccgccgaggcgaatggtttcttcacagatgatcttgttgagcggattgtggtacttgtcgatttcctcttccggcttacagtcaacgacgttgtaatcgtagacgaagtacatgttggtgccgttctgatagctatgagaggaatgaccgcccagcatggtgatgtcgtcggcgtgcgggaactcagtacgaatacggttaataacgctttcgtagatttcgtggatgcagctccagcagccggatacttcggtggtaaagcccatgttgccggttttgaggatctgcacacgttcggcagccactttatccggtccccagttcaggttgttaaaccaggtttcgatcagcttgctgtccacgcgctggcattgcgggtagcgggcaacgatttccgcaatcccttcgcccgtcaccttcgcaatgcgagggttaccttcagccataaagatcagcacgcattttccgtcggcaaaatgggtgaagtgttgggtgccatcttcagcgtcatacaaacgagcgattgacggacgatacccttccaccatgatttcacgcaggatgttgaagccggttttcatgtcttccaggatatagccgtagaagaggttgttttccggggtgaatttaaagattttcactgttacttcagtgatatagcacaatgcaccttcgttgccgatgatgatgtgacgaatgtccgggccagccgcgcggcgtggcacgtttttaatgcgtgtgacggtgccatcagccaatactgcttccagaccaacgaccatatcttcgattgcgccgtagagtgtggagaactgcccgatacttcgggttgctaccaggccgcccatctgcgccagcggctttgactgcggagaatgccccgtggtgtaacctttttcacgcaacgcgttttccagcacttccagcggaacaccacattgcgccgtcgcctgcatattctcaatatcaatattaatgatttgattcatggcggagccgtcgagcaccaccgagttttctacaacagtttccagcccaccttcggtggcggaagcaccggtacgcggcacaccgttaattttgtgcgcattcataaaattcagcacacgggatacttgctctgtggaaccgagttttacgaccgctgccggaatcggcaaagtataaatgccatgaatatccggaaatttacgaaaacggtcaatactgtttttctttaatactgtttcatcggtaattacgcgatctgcaccaacaatttcctttagctggtcgacaatcgctgcgcgagataaagacatagtaattccttcctgataataaaaatggaataatcattaataagagaaaacagaaaccaccgttatgggttagcgcactaaataaccgccatcaaccactaataaatgcccgttgacataattcgatgccggacttgcgaggaatacggctgcgcccattaaatcctgagtatcgccccaacggtttgccggaatatgatcaagaacgcgctgattggtttctggattactgcgtgtcgccagcgtaatatctgttgcataatagccaggggcgataccatttacctgaatattatattgacctagttcatcacaataagctttggtgaacccggcaagagcatgtttagtggcagaatatgcaggtgaccattgtccacctaagtaagagaacaatgaacagatattaataattttgccgcttttctgcgggatcataatttttgcagcttcatagcttaactcgaatgcggcggtcaggttcacatcaatcatcggatcccagtcggcacgaccgaagtccagcaccttattcagcttacaaataccggcattgttaaccagaatatcaactgtaccgaaacgctcacagcaagcagcgataatcttctgcggcgcgccttctgcggtgatacccacctgcatgaagtccacctcaacaccctgtttttcaatcatttcctttgtttcgccgttatctttgacgaaactaggaataaagatatttgcgccagctttggccaacgccatggcaaatgcctggcctaaaccgctattcccaccggtaacaattgcggttttacctttcagggagaaaaaatccattgagaacgcattgagagattcgattgacatagttagctccaatttccgtaaggcaaaaaaaaagaaaggtaacttcccccgcgagagggaagttacctttctcattatctctggtaactggagataatttttagcataagggcataactgctaatgtgatcgtaatcacagtgtgatattcgtattgtcaaataattttaaaaagcagaagcgtgattactctcacacaacacctctgctttccatgttatttattatttcaattactagagacctgagaaaagtaatccacctgaaagggcggcttacttttctcttttttttgtctattacaaatgggaatacgatatgcaacacaactcatatcgccgttggataaccctcgcgataattagttttagcggcggcgttagtttcgacctggcttatttacgttatatttatcaaattcccatggcgaaatttatgggattcagcaataccgagataggtttaataatgagtacctttggtattgcggccattattctttatgcccccagcggcgttattgccgataaattttcacaccgcaaaatgattacttccgcgatgatcattaccggattactgggtctgttaatggcaacgtatccaccgctgtgggtaatgctctgtattcagatcgcctttgcgataacgacgattttaatgctgtggtcggtgtcgattaaagctgcatcgttgcttggcgatcatagcgagcaagggaaaattatgggctggatggaagggctgcgcggcgtcggtgtaatgtcgctggcggtgtttaccatgtgggtcttttctcgctttgcaccggatgacagcaccagcctgaaaacggtcattatcatctatagtgtggtttacatcttgttggggattctgtgctggttttttgttagcgataacaacaacctgcgcagtgccaataacgaagaaaaacagtcattccagcttagcgacatcctggccgttttgcgtatcagcaccacctggtattgcagcatggtgatttttggcgtcttcaccatctacgccattctgagttactccaccaactatctgaccgaaatgtatggcatgtcgctggtggcggcgagctacatggggattgtgatcaacaaaatattccgcgcgctgtgcggcccacttggcggcataatcaccacctacagcaaagtgaaatcccctacccgcgtgatccaaatcctttccgtactcggcctgctgacgttaactgccctgctcgtcacgaactctaacccgcaatcggtcgcgatggggattggcctgattttactgctgggattcacctgttacgcctcacgcgggctgtactgggcctgccctggcgaagcgagaacaccgtcttacattatgggcaccacggtaggtatttgttcggtgattggattcctgccggatgtcttcgtttacccaattatcggccactggcaagacaccctgcccgctgcagaagcctaccgcaatatgtggctgatgggcatggcggcgcttggcatggtgattgtctttacctttttgctgttccaaaaaattcgtactgctgatagcgcccccgcaatggctagcagcaagtaagccaggaaaattacaggagaaaaatcatgtcgaaaaaatacatcatagggattgatggcggaagtcagagcacaaaagtggtgatgtacgatctggaaggtaacgtggtttgcgaaggcaaaggcttattacagccgatgcacacgccagatgccgatactgcagaacatcctgacgacgatttatgggcatcattatgttttgccggtcacgatttgatgagtcagtttgccgggaataaagaagatattgtcggtattggtctgggatccatccgttgctgccgtgcgttattgaaagccgatggcacgcctgctgcgccgttgattagctggcaggatgcacgcgttacacgcccttacgaacacactaaccctgacgtggcatatgtcacctctttttcgggttatctgacgcatcgcttaaccggcgagtttaaagacaatatcgccaactattttggtcagtggccggtggattataagagctgggcatggagcgaagatgctgcggtaatggataagtttaatatcccccgtcatatgctgtttgatgtgcaaatgcctggcaccgtcctcggacatatcacaccacaagccgcactggcgacacatttcccggcaggactgccggttgtttgtaccaccagtgataaaccggtagaagctctgggggccggattactggatgatgaaacggcggtaatttctcttggcacttacatcgcattgatgatgaacggcaaagcactgccgaaagatccagtagcgtactggccgattatgtcttctattccgcaaacattgctgtatgaaggttacggtattcgcaaaggcatgtggacggtgagctggctgcgcgacatgctaggcgagtcgttaattcaggatgccagggcgcaggatctttcaccggaagatttactcaacaaaaaagcttcttgtgtgccgccaggctgtaatggtctgatgacggtgctggactggctgaccaatccgtgggaaccgtacaaacgcgggattatgatcggctttgattccagcatggattacgcatggatatatcgttcgatactggaaagcgtggcgctgacgctgaagaacaattacgacaatatgtgtaatgaaatgaatcactttgcgaagcatgtgatcattactggcggcggttcgaacagcgatctgtttatgcagatttttgccgacgtgttcaaccttccggcacgacgtaacgccattaacggttgtgcaagcctgggggcagcgattaatacagcggtaggtctggggctatacccggattacgcaacggctgtcgataacatggttcgcgtgaaagatatctttataccgattgagagcaatgccaaacgctacgacgcgatgaataaaggcattttcaaagacctaaccaaacatactgatgtgatcctgaaaaaatcgtatgaagtgatgcatggggaattggggaatgtggattcgatccagagctggtcgaatgcgtaagtgaggaaggccgggcgggaaactgcccggcctgaacatacctgaatggttatccccgctgacgcggggaacataagttcgacaacttaaaaaatgataacaagtccggtttatccccgctgatgcagggaacataataaaaactttaactagttcggtttatccctgtttttacaaggaatattaactacactcgatgtctttagaataaaagacaatacgaatcgcactttatcaattttcacttaaagtatgaactggatatctttattcataagaactattcatcaacagcgtatagaggcggttatgtaaaaccactcattagcctcaaaacaaagacaaacttccagatttattacttaaccaatgaataacaagcttaaaaaatatactgttattctaaagaaaaaattaacaggcattaattcaatattaaaaaaataatagattaaaatttcttaacgatttaagaatcatacaaataacactttgattaaatttaattttttgtatcgataattgtgaacctctctggcatggagaactattttgaacatgaggtgttacgtggatatgttgcttattacaagtactgctaatataaaaacttgagaaagagataacgggttatatggtggtttatccccgctggcgcggggaactcgacagaacggcctcagtagtctcgtcaggctccggtttatccccgctggcgcggggaacacctgttttcgcaaatctatggactattgctattcggtttatccccgctggcgcggggaacacgggcgcacggaatacaaagccgtgtatctgctcggtttatccccgctggcgcggggaacactggctctgcaacagcagcacccatgaccacgtcggtttatccccgctggcgcggggaacacgaaatgctggtgagcgttaatgccgcaaacacaggtttatccccgctggcgcggggaacacattacgcctttttgcgattgcccggtttttgccggtttatccccgctggcgcggggaacactctaaacataacctattattaattaatgattttttaagccagtcacaatctaccaactttatagtatcacacaaacaacacatccattatgttaaagagcacttaatccattgattaaaaaggtaaatatttaaaataactctatacaaactaaaatctaccaaactttaccgcaataattttcactccagcgaaaaattaatgccacagaatttgtagagaatgctaatgattagccctggatgggtaaaatggaggagttttcagaggcgacaaacaatataaatgagtagaagtctttacaggttccacccatttataacgcttataaatgtttaatcaggcaatatttagatatttatgtgtttgcatcgacaaacgccaattacgcgcaatgcaggtttcaatgcacaaacgtgtggcatcatccttttggctaatcggctgcagtgcaatgactcgcggtttatcatcggtcagcgttgccagtagttcatccagtgcttcaatatcgcgtacgcgccccactggatgcttgatttcgttggctcgctccagtgcctgtgacaacacttcatagccgccgcgcatgttcagctttggcgatacggtaacccaggtattcggtgtgcagcgtacctcatgagtaccactggtttcgatctggcagctaaaaccgttcttttcgagcagatcagtcagtggcagcaaatcatgaatgcaaggctcaccacccgtaatcaccacatgccgcgcggtgtatccctggcgaccaatgacagccagcaaatcttcactgctcgcagccccccacttatcactctctttggtcttcgccagaatgctgaaaagggagacttcccgatcctcaagcttttcccaggtgtgtttggtgtcgcaccaggcacagccaaccgggcatccctgtaaacgaataaaaatggcgggaacgccggtaaagtaaccctcaccttgcagggtctggaacatctcgttaatcgggtactgcatagcattctctgtgaagtggataattgttaattattgcagatcctgccacaacaatcatgtcttattaacattctgttacaggcaggtttaaagaaaaatgcgaaacatatcgttaataattaaagggagtaacgtattatgtcagaagaaaataaagaaaatggatttaatcatgtcaaaacattcaccaaaattatatttattttttctgtattagtttttaatgataacgaatataaaattaccgatgccgccgtcaatttatttatccagatttaatgagaaatttataatgcgctatttcatactaatgttcactttcgtatgttcctttgttgcagcccaaccaactattgtcccacaattacagcaacaagttacggatcttacgagtagcttaaactcacaagaaaagaaagaactgacgcacaagttagaatctattttcaataatacccaagtgcaaattgccgtattaattgttcccacaaccaaagacgagacaattgaacaatatgctacaagagtttttgacaattggcgtttaggagatgccaaacgtaatgatgggatactgatcgttgttgcctggtcggatcgcactgtccgcatccaggtaggttatgggctggaagaaaaggtaaccgatgctctggctggagatatcatccgtagcaacatgatacccgcatttaaacaacaaaaattagctaagggattagagctagctataaacgctttgaataaccaactcacttcacaacaccaatatccgactaatccttcagaaagtgaatcagcgtcttccagtgatcattattactttgctattttttgggtatttgcagtgatgttcttccctttctggttttttcatcaaggcagtaatttttgtcgcgcatgtaaaagtggagtctgtatttcagcaatctatcttttagatttattcctgttctccgataaaattttttccattgctgtattttccttcttttttactttcaccatatttatggtctttacctgtttatgtgtacttcagaaaagagcatctggtagaagttatcattcagacaacagcggttccgctggaggctcagatagcggcggatttagcggcgggggcggttcttctggaggtggcggcgcatccggccgctggtaactcaaccataaaaaatgccagcccggaggctggcatttttaaatcagataaagtcagtcttatgcctggcctttgatctctttacgaccgttgtacggtgctttttcgcccagagcttcttcgatacgaatcagctggttgtatttagcaacacggtcagaacggctcatagaaccagttttgatctggcctgcagcagtaccaacagccaggtcagcgatggtagcgtcttcagtttcgccagaacggtgagagataactgcagtgtagccagcatctttcgccatcttgattgcagccagagtttcggtcagagaaccgatctggttgaatttgatcaggatggagttagcgatacctttttcgataccttctttcaggatcttggtgttggttacgaacaggtcgtcaccaaccagctggattttgtcgcccagaactttggtctggtatgcgaaaccgtcccagtcagattcgtccagaccgtcttcgatagaaacgatcgggtactgtttggtcagttcttccaggaagtgagtgaattcttcagaggtgaacgctttgttgccttcgccagccagaacgtatttaccatctttgtagaattcagaagctgcgcagtccatcgccaaagtgatgtctttgcccagttcataaccagcagctttaacagcttcagcgataacagccagagcttcagcgttggaacccaggttcggcgcatagccaccttcgtcaccaacagcagtgttcatgcctttcgctttcagaacttttgccaggtgatggaaaacttcagaacccatgcggatggcttctttcacagttttcgcgccaaccggctgaatcatgaattcctggatatcaacgttgttgtcagcgtgctcaccaccgttgatgatgttcatcatcggaaccggcatagagtatttgcccggagtaccgttcagttcagcgatgtgctcgtacagcggcatacctttagcagctgcagcagctttggcgttagccagagatacagccaggattgcgttcgcgccgaatttggatttgttttcggtgccgtccaggtcgatcatgatcttgtcaatgccagcctgatctttagcatctttgccaatcagcgcctgagcgatcgggccgtttaccgcagcaacagctttggttacgcctttacccaggaaacgggatttgtcgccatcgcgcagttccagagcttcacgggaaccagtagaagcacctgacggagcagctgccataccgacgaaaccaccctccagatgtacttcggcttcaacagtcgggttaccacgggagtcgatgatttcacgaccgatgatttttacgattttggacattaggttttcctcaagtcactagttaaactgaaactccagacaaacaacgcgtacccagggtacgcgttgccgctctaacttttttacttacttcgcctgacgtttctggaactcgctggcggctttcacaaagcctgcaaacagcgggtgaccatcacgtggagtagaagtaaactccggatggaactggcaagccacgaaccacgggtgattcggaacttcgatgatctcgaccaactgatcatccccggaacggcccgcaacgcgcagacctgcatcttcaatctgtttcaacagcatgttgttgacttcgtaacggtgacgatgacgctcaacaattgtcggcgcattgtacagctggcgaaccaggctatcgtcaaccaactggcactgctgtgcgccgagacgcatggtaccgccgagatcgctcttctcgctacgaacttcaacgttgccgttttcatcgcgccactcggtaatcagcgccacaaccgggtacttacagtctggcacaaattccgtagagttggcgttctccatgttggcaacatggcgagcgtaatcaattaacgccacctgcatacccaggcaaatgcccagataaggaatattgttctcacgcgcaaaacgcgcggtcgtaatcatgccttctacgccacgatagccgaaaccgccaggtacgaggattgcgtccagacctttaaggatttcaacgccgcgcgtttcaacatcttgtgaatcgatcagtttgatgttgacgctgacacgattcttcagcccaccgtgtttcagtgcttcgatcactgatttataagcatccggcagttcaatgtacttgccgaccataccgatggtgacttcacttaccgggttcgcttcttcgaagataacctgttcccattcggacagattcgcttccgggcagtttaagctgaatcgtttacaaatataatcgtccagcccctgagatttcaacaggcccggaattttatagatggaatcgacgtctttcagagaaataaccgctttttccggaacattacagaacaatgcaatcttcgcacgttcgttcgccggaacagcgcgatctgaacgacaaatcaggatgtcaggctggataccgatggagagcagctcttttacagagtgctgagtcggtttggttttgacttcaccagacgctgccatgtacggcaccagcgtcaggtgcataaacagagtgtgctcacggccaatttcaacagccatctggcgaatcgcttcgaggaacggcaaggattcgatatcacctactgtaccgccgatttctaccagtactacgtcatgaccttcgccaccttccagcacgcgctctttgattgcgttagtgatgtgcggaataacctgcacggttgcgccgaggtagtcaccgcggcgttctttacgcagaacgtcagagtagatacgacccgtggtgaagttgttgcggcggctcattttggtacgaatgaaacgctcgtagtgccccaggtccaggtcggtttcagcgccgtcttcagtaacgaacacttccccgtgttggattgggctcatagtacctggatcgacgttgatgtacggatccagtttcatgatggtcacattgaggccacgggcttcaagaatggctgcgagggaggctgcggcaatgcctttacccagagaggatacgaccccgccggtcacaaaaatatagttcgttgtcatgctgaacctgagaagttaggttgaaaagacgatggaataaccaagacgggaaagcagtatacccgaacatgacctgtgccacaaactttcattatccctcctcttcgccagcgcactattgaaatcaggagtgagaaaatagcccctttggggtaaatgtttttgacgcaaatcaagcgcttgtcatttaaaaaatgacacaaatggcgcttgaccgcgtaattcccttagagatcaatttcctgccgttttacctgttgccagacttcttccattgtttcgaggtcaacacctgtcatttccagtccacgcgcggcaacaatacgctccacttcgcgaaaacgacgctcgaatttttcgttcgctttttgcaatgcgatttctgctttcgtccctaaatggcgagccagattaaccgtggcaaacagcaggtcccccatttcctcctccagtttagcctggtcgacaacagcctgccgcgcttcgtacatcacctcgtcgatctcttcgtagactttatcgactaccggaccaagcgtcgtccaatcgaagccaacgttggcgcaacgtttctggattttttgcgcacgcattaaagccggtaaactacgaggaatatcgtccagcgccgaatgctgcgctttctgcgcgcgctcttcggttttgatttgctcccaacgggcaagcacttcactactgttttcggcagaactatcagcaaaaacatgcggatggcgacgctctaatttatcgctaatagcagcgcaaatatcattaaagtcaaagcgcccttcttcctgagccatttgcgcgtaaaacaccacctggaatagcagatcgcccagttcaccgcgaagatcgtcaaaatcttcacgggcgatggcgtccagcacttcgtaggtttcttcaagggtgtaaggcgcaatggtggcaaatgtctgctctttatcccacgggcagccgttttccggatcgcgcaggcgctgcataatagtgagcaaacggtcgatttgattcattgaattgtcctgaaaattgcgggtctgtcaggtggaaacctgtgaccagaatagaagtgagttagtaacactacccaatcagtacgttaattttggctttaatgagttgtaattcctctggggcaactgttcctttcttcgttgctcctcttgcccgccaggcgatactttttacctgatcagctaacgctacgccatcacgttcctgaccggataaaacaacttcgaacggatatccttttgattgcgttgtacaaggaacacacagacacatacctgttttgttgttgtacatgaaaggactcaggacaacagctggacgatgtccagcttgctcgctaccttttgtcgggtcaaaatcaacccaaatcagatcgcccatatcgggtacgtatcggcttaccattaccagacttccttatctttcggctctccccagtcgatattctcgtggaggttttccggcgtgatgtcgttgaccagttcagcaagcgtaaatacgggctctttacgcactggctcaataattaatttgccatccaccaggtcaatcttcacttcatcatcaatattcagattgagcgcctgcattaacgtagccgggatccgcaccgccggtgaatttccccaacgctttacgctactgtggatcataaccctttcctcaaaccgctatcatatgtagatacagtatatatcaatctacattgtagatacgagcaaatttcggcctaactcccgtgcaaccgacgcgcgtcgataacatccggcacctggttgagtttacccagcacgcgccccagcacttgcaggttgtaaatctcaatggtcatgtcgatggtcgccagttgctgtttggtgtcgctacggctggcaacgccaagcacgttcaccttctcgttggcgagaatggtcgtgatatcacgtaacaacccactacgatcattagctaccacgcggaccaccagcgaatatccggcggagtagctctcaccccataccgcgtcaacaatgcgttctggcgcatgggagcgcagttccgccagttgttcgcaatcggcgcggtgtactgaaataccgcgcccctgggtaatgaagccgacaatctcatctccaggaatcggctggcagcagcgcgcgatgtggtgcatcaggttgccaacaccttcgactaccacgcgaccgttatctttactgcggttttgcggcgtgtagcttttttgctgaagttgcttcagcgcggcggcgtcctgctcttcggcactcggcttattaaattgcgattgcaggaagttcaccatctgattgagacggatatccccgccaccaatcgccgccagcaactcgtcgacatcattgaagttgtaacgcggcagcagatgtttttctgcttctttcaggctgatccccagatgttccagctcgtcgtcaaggatttgccgcccagccagaatgtttttgtcacggtcctgtttacggaaccaggcgtgaattttcgaacgcccacggctggttgtgacgtaaccgaggtttgggtttaaccagtcacggctggggttcggctgtttctgggtgataatttcaatctggtcgcccatctgcagctggtaggtgaacggcacaatgcgcccgccaatttttgccccgatgcagcggtgtccgacatcactgtggatgtggtaagcgaagtccagcggcgttgatcccgcaggcaaatcaacgacatcacctttcggcgtaaagacgtacacccggtcgtcaaagacctgactacgtacttcgtcgagcatttcgccggaatcagccatctcttcctgccacgcaatcagtttacgcagccaggcaatccggtcttcatgtcccgaacgtgcgccgccagcagccgcgccctctttatatttccagtgcgcagcaacacccaactctgcatcttcatgcatctgtttggtgcggatttggatctcaacggtttttccacccggccccagaaccacggtatgaatagactgataaccgtttggtttcgggttagcgacgtaatcgtcaaactcatccggcaggtggcgatagtgagtgtgcactatccccagtgcggcatagcaatcctgtaaacgctcggcgacaatacgtaccgcacgcacatcaaacagctcatcaaaggcgaggttctttttctgcattttacgccagatgctgtagatgtgtttcggacgaccatacacttccgctttaacgccttcagctttcatctcagcgcgcagatgaccaacgaactcttcgatgtagtgttcgcggtcgagacgccgttcatgcagcagtttggcaattcgtttgtattcggttggatggaggtaacggaagcagtaatcttccagttcccatttcagttgtccgattccgagacggttagccagcggtgcgtagatgttggtacactcttttgccgccagtacacgttcatcttccggcgcatcttttacttcgcgcagatgagcaatacgctccgccagtttgatgactacgcagcgaaaatcatcgaccatcgccaataacatccggcgaacgttatcgacctgttcggaggaaacagaatcagtgtgcgtcgctttcagctggcggatcgccgccatatcacgcacgccgtgaataaggttaacgaccgacttaccgacgctctcacgcagcacatcttcgctgactacgttggcatccgccagagggaaaagcagcgccgcccgcagcgtgtcaatgtccatacttaatgtcgagaggatctccaccatctcaacaccacgccacaataacagactggcatccggatgcccctgcgtctgttgcagacaatacgcccaggtttcggctaagcactcacacgacttctggctggtaatacccagacttgcgatccatttttccggatcaaattcaccagccttattgatatgtgcacttcttaccgcaaccatcgtcctctcctttagggaccagacctgccgaaatcggcaaatcgcaactatttaacgcgcgagaaaagtaccatcgattccagatgtcccgtgtgtgggaacatatccagcatcgccagtcgcgcaatggtatatcctgcttttaataacgcttcgctatcccgagccagcgttgcagggttacaggatacataaactatacgaataggttccagttttataatttgctgcataacacctgcggcacctgctcgcgccgggtccagcaacactttatcgaagccgtttttcgcccacggctgctttgtgacatcttcttcaagattttcgtgataaaacgtcacattctgtaagccattaagacgcgcattctgctggcctttttccaccagcgccggaacaccttctacaccgaccacactggcagcttgtgtcgccaatggcagtgtaaagttgcccataccgcagaacagatccagtacgcgatcttcaggttgcacatccagccattccaacgcacgcgctaccattttttggttcacacccgcattgacctgaataaaatcgcgcgggctaaaagttaagcgcaacccgtttgagtcataccagggcatctcaccagagacggtttcgagtatctcactatcgggggcgagatacagatccaggccttcagaatgcgaaaagcgttccagtttttcgcgatctgccgaacttagcggtgcggtatggcgcaaaatcatcagcgtgccgctggttgcctgtaccagttcaacatgaccaagatggcgcatagcttgtaagctgcccagacatgccctgactttgggcagcaatgcttcaagttggggcgctaaaatggggcattgtttgacgtcgacaatgtcactggagcccgctttgcgaaaccccatctgaagttgctgtgttttcggtaagtagttcagacttaaacgcgcgcgacggcgatagccccagggaacatcggcgatcacttcagagacatcgtgtttcattaatcgggcgagtgccgcacttttgcttcgctgctgtaaatccacgctggcgtgttgttgctgacagccaccgcatacgccaaaatgaggacagcgtggcgtttcgcgttccgggctatcgcttaaccggcgtacgactttagcgcgggcatactgttttttatcttcagtaacagtaacttccgcgttttcctgcggcaataatccggggataaatagcgttttgccgttatgtcgcgccacgccctgaccaaaagagtcgaggtcgttgactgaaacggttatgatctgacgcgtcgtcgtgcgtcgttttgcagagtagaattgcgccattggcgagactttctcaatttaacagtgtgaccttaattgtcccataacggaactccatgaccaactacagcctgcgcgcacgcatgatgattctgatcctggcaccgaccgtccttattggtttattgctgagtatctttttcgtcgtgcatcgctataacgacttgcagcgtcaactggaagatgccggtgccagcattattgagccgcttgcagtttctactgaatatggcatgagcctgcaaaatcgcgaatctatcggtcagttaataagcgtactgcatcgtcgccattccgatattgttcgcgcgatttcggtttatgatgaaaataaccgactctttgtcacctccaattttcatcttgatccctcatcaatgcagctcggcagcaacgtgccgtttcctcgccagctcactgtcactcgtgacggcgatattatgatcctccgcacgccgattatttctgagagttactcccccgacgaatcgcccagtagcgatgccaaaaatagtcaaaatatgttgggatatattgcgctggagctggatcttaaatcggttcgcttgcagcaatataaagagatctttatttccagcgtgatgatgctgttttgtatcggtattgcgcttatttttggctggcgcttaatgcgcgatgtaaccggtccgattcgcaacatggtgaataccgtcgaccgcatccgtcgcgggcaactcgacagccgggtggaaggatttatgctcggcgagctggatatgctgaaaaacggtatcaactcgatggcaatgtcgctggctgcttatcacgaagagatgcagcacaatatcgaccaggcgacgtccgatctgcgtgaaacgctggagcagatggaaattcagaacgttgagttagatctggcgaaaaagcgcgcccaggaagcggcgcgtattaaatccgagtttctggcaaatatgtcacacgagctgcgtacaccactgaatggtgttattggctttacccgcctgacgctgaaaacagaattaacaccaacgcagcgcgatcacctgaatacgattgaacgttcggcaaataatttgctggcaattattaatgatgttctcgacttctcgaaactggaagcaggtaagctgattctggaaagtattccattcccactacgcagcacgctggatgaagtcgttactctgctggcacattcttctcacgataaagggttagaactgacgctcaatattaaaagcgacgtgcctgataacgtgatcggcgacccgctgcgattacagcaaatcatcactaacctggtggggaatgcaattaaattcaccgagaatggcaacattgatattctggtagaaaaacgtgcgctgagtaataccaaagtgcagattgaagtgcagattcgggataccggcattggtattcctgaacgcgatcaatcgcgcttattccaggccttccgacaggctgatgccagtatttcccgccgtcatggtggcaccgggctggggctggtgattacacaaaaactggttaatgaaatgggcggcgatatttcgttccatagccagccgaatcgcggttcaactttctggttccacattaatctcgatctgaacccgaacattattatcgaagggccatccacccagtgcctcgcaggtaagcgcctggcctatgtcgaaccaaactccgcagcagcgcaatgcacgctggatattttaagtgaaacgccgctggaagtggtttatagcccaacgttctccgcgctgcctcccgcgcattacgacatgatgttgttaggcatcgcggtgaccttccgcgagccgctaacaatgcaacatgagcgattagcgaaagcggtatcgatgaccgatttcctgatgctggcacttccttgccatgcacaagtcaatgctgaaaaactcaagcaagatggtatcggcgcgtgtctgctgaaaccattaacacctacacgcctgttgcctgccctgacggaattttgtcatcacaaacaaaacacgcttttgcctgtaaccgatgaaagtaagctggcaatgacagtcatggcggttgatgacaaccccgctaacctgaaacttatcggcgcattgctggaagatatggtgcaacatgtggaactttgcgatagcgggcatcaggcggttgaacgggcgaaacagatgccgttcgatttgatcttaatggatattcaaatgccggacatggatggcattcgggcctgcgaactcatccaccaactcccgcatcagcaacaaacgccggttatcgcggtaacggcgcatgcaatggccgggcaaaaagagaagctgcttggcgcagggatgagcgattatctggcgaaaccgattgaagaagagcgattgcataatttgttgttgcgctacaagcctggcagcggtatttcctctcgcgtcgtgacgcccgaagtcaacgaaattgtggtgaacccgaatgcgaccctcgactggcaactggcactacgccaggcagcaggaaaaaccgatttagcgcgcgatatgctgcaaatgttactcgatttcctgcctgaagttcgcaacaaagttgaggaacagctggttggagaaaacccggaaggcctggttgatttgattcataaactgcatggcagttgcggctatagcggtgtgccacgtatgaagaatctctgccaactgatcgaacaacagctacgtagcggtactaaagaagaagatttggaaccggagctgctggaactgttggacgagatggataatgtcgcgcgcgaagccagcaaaattctcgggtaatggatgtcttgtcgagtagcaatcggctttttatgacgctggtttcagattggtgacaaagtgcctgtgtttatgccggatgcggcgttaacgccttatccggcctacaaaaccaattaaattcaatgaattaaaaaatgatgtagacctgatacatagcacaacaggctattttgcgtttagcatcagtctcaaaccggctccagatagagccggttttggttttctgtcttaacgcaccatgcacgggcgcttgttatcgaacgtccagccaggaatcagatactgcattcccatcgcatcgtcacgcgcgccaagcccgtgtttctgatacagctcatgggctttcatcacttgatccatatcgatttctacacccagccccggtttttctggcacctgtaccagcccgcctttgatctcaaacggttctttggtcaggcgctgattgccttcctgccaaatccagtgcgtatcaatagcagtaattttacccggtgcagcggcggcaacatgggtaaacatcgccagggaaatatcgaagtggttgttagagtgtgaaccccaggtcaggccaaattcatggcacatttgcgccacacgtaccgaaccttgcattgtccagaaatgcggatccgccagcgggatatcaacggattgcagggagagcgtatggcccatttgccgccagtcggtggcgatcatattggttgcagtcggtagacctgtcgcgcgacggaactctgccatcacttcacgcccggagaaaccttgctccgcaccacacggatcttctgcataagccagcgaacctttcaggtatttaccgattttaatcgcttcgttcagcgaccaggcaccgttaggatcgagcgtaatacgcgcctgcgggaagcgttgcgccagtgccacaatagactcggcctcttcttccccggccagtacaccgcccttcagtttgaaatcgttgaagccatatttttcatatgccgcttccgccaggcgcaccaccgcatccggcgtcatcgcttcttcatgacgcaggcgataccagtcgcatgagtcatccggctggctttgatacggcagcggcgtggctttgcgattaccgacgaagaacagataaccgagcatttcgacttcgctacgctgttgaccatcgcccagcagcgatgccacgtttacccccagatgctgccccagcagatccagcattgccgcttctatcccggtaactacatgaatagtggtacgtaggtcaaatgtctgcaaaccgcgcccaccagcatcacgatcggcaaaagtattacgcaccagcgtcagaacgtttttgtattcacccagcgttttacctaccaccagcggaatcgcatcttccagcgttttacggattttctcgccgccgggaatttcccctacgccagtgtgaccagaattatctttgataatcacaatattacgcgtaaagaacggtgcgtgtgcaccactcagattcatcagcatactgtcatgacccgccaccgggataacctgcatttcagtaacaacaggcgtcgtaaattgagaactcatatttatgtcctttttcagaatcaatgacggccgaaaacgggacgtttacggtcaaaggtccagccggggatcaggtactgcatcggacctgcgtcgttacgcgcaccgccaggcagacgtttataggcctcatgtgccttttgtacctgttcccagtccagttccacgcccagaccgggcgcatcaggaacggcaatttttccgtttttaatctccagcggattttgggtcaggcgacaatcgccctcctgccaaatccagtgggtatcgatagcggtaggattacccggtgccgccgcgcccacatgggtaaacatcgccagagagatatcgaaatggttattagaatggcagccccaggtcagcccccagtcgtcgcaaagctgcgccacacggactgcaccggaaagcgtccagaagtgcggatcggcaagtggaatatctaccgcattgagcatcaccgcatgacccatttcgcgccagttggtggcgatcatgttagtcgcgacgggcaagccggtcgcccgtcgaaattccgccatcacttcacgtccggagaagccctgttctgcgccgcatggatcttcggcataggtaagaacatcattcagccctttgcataaagaaatggcttcatcaagcagccatgcaccgttgggatcaacggtaatccgcgcatccgggaagcgtttcttcaatgcacgaacagtgtcgatttcttgctcgccaggtaacacgccgcccttaagtttgaaatctttaaagccgtagcgatcctgtgaggcttccgccagacgcacaacggcttcgctgttcattgctttctgatgccgcaactgataccactcatggttgcccggcgtattttccacataaggaagatcggttttggtccgatcaccgatataaaacagataaccgaggacggtaatagcctcgcgttgcttgcctggccctaacagttcgcagaccggaacattcagcgccttacctagcaggtcaagcaaagcggcttccagcgccgccacggcgttaacgcgtaattcaaaggtccaggcacctttaccgaaggtatcaaaatcggcggcctgattacctttatgcacctgctggaccactttattcagtcgcgcaacttcctggcccagaaccatcggaatagcatcgacaagcgtctgataaatcacatctccgcccggcgcttcaccaatgccggtatgcccggcgttatcggtgagtaccacaatattgcgggtgaaatatgcgttatgtgccccaccaatattaagcaacatgctgtcatgcccggccaccggaatgactttcatatcagtaataacaggactggattgtgtcgccatcttattgccccgcaacaggtttcaactcgatacgcttgatatcgcccaccagcaccaggtagctcagtaccgcgattaaggcatgaacaccaacataaatcagcgccccattaaacgagccagtcgtgccaacgatataaccaattgcgattggcgtgacgatgccagaaatgttaccgaacatgttgaacaggccaccggaaagaccgctgatctcttttggcgcggtatctgccattactgcccaacccagcgccccgatgcccttaccgaagaaggccagcgccataaagccgatgatcatccactcaacgttgacgtagttgcagaacaccatcaccatcgacagcaacatgcccattacgatcggtgttttacgcgcaatgttcagcgatcccgtgcggcgcatcagccagtcggaaataatcccacccagcacaccgccgataaaaccgcaaaccgccggaacggaagccacaaagcccgctttcagaatcgacatcccgcgtgcctgcaccagataaaccgggaaccaggtaataaagaagtaagtcagggcgttgatacagtactgaccgatataaacgccgatcatcatccgtgaccctagcagctgtttgatctgcccccacttcacgctgaacggcactttaactttggtgttttgctgatccatattgatcagcgcaccacccgcggcgatgtactccagctctttcttatttacccccggatgttgatttggctcgtggatgactttcaaccagataaagctgatgacaatccccagaccgcccataaagaagaagacgtgtgaccagcccacttcatgcgtcagccagcccataatcggcgcgaagatcaccgttgcgaagtattgagcggagttaaaaatcgacaccgccgttcccctttcctgcgccggaaaccaggccgcaacaatgcgactgttgccggggaaagatggcgcttcagcaagcccgaccaggaagcgcagcgtaaacagggcaacgataatgccgaatccactaaagatatcgacgaagccttgcagcaaggtaaacatcgaccagataaagatcgaccagaagtagacgcgttttgaaccaaaacggtccagcaaccagccaccagggatctgcccgataacataagcccatgagaaagcagagaacacatagcccattcccacgggatcaaggccgatatctttggccatttccgaaccggcgatagagagcgtagcgcggtcgccgtagttgaaggatgtgacgataaacaacatcaccactatccagtaacgagcatttgtgcgtttttccacactgctcgcagcctgacttaaagaactcattgttgcactcctgaaaattcgcgttagccacgctcactctggactgcgacatcgccaggaaatcagaggtgacgtagggtgttttttgccgtttttataggtcgttcgccgaatacggcgcgtgtttatatctggcaatagcagtataaaaagcgcgccatagcggctcaccgtgcaacaacacaacattaatgcgttcaatgaggcccgattttggcattagccctggacggtggaatccacttcacggaaatgaaaacaagaacaagaaaggaagggttaaaacgaagaaataaagaagagtatgaaatggatcgcttgactccaggcaaacgccagtaaaaatccgcgctatgaagcagtttttactggcatttgcctgaaaagattcgattcagcaccgctaaaacgacatttaccgctcgctgaacatatcaggacaacagcgtgccccactgttcgacccacggatttgattccgtttccggttccgggttctcactggcgtcaatcaacagcatttcgccaacccgctgagcgctctgttcctgcaacaaggcatcgaactgtttgccgccattgcagaaattcacataactactgtcgccgagcgcaatcacgccataacgcagattcggctggaagcccagactatctttgattccctgaaagagtggcacaatgctatcaggaaggtcgccctgcccggtcgtggacgtaaccaccagaacatacttatcctgatagggcagccagtcgcttaattcaggatcttcaaataccgttgctttgtggccctgcgcggtcagaatcgcttccgcttcttcggccactaacagtgaattcccgtacatggtgccgacaaaaataccaatttccgccataccgttttctccctggattaggaacttatctctccatcctgacccgatggcgcactgaactcaaccctttcattttcaggaagcagaccgcgccagccaaattgtgataacgcctgcatccaggtgtcgtccaggcccgcgtgaatagtcagcggctcgccagtaaaaggatgcgtcaatgacaactgactggcatgtagcattaaccgctggaggccaaaatgctcagcaccgctgcgattctggcgtaaatcgccatgtttgctatcgccaataatcggatgacgcaaatgggcaagatgtcggcgaagctgatgtttgcgtccggttttcggctccagttccaccaggccgtagcgcgtggtcgggtaacgtccggtcgctaccggcatttctacggtcgccagaccgcgataatgcgtcactgctggctgcgggcctttatcttcgcgggcaaatttatcagcgattttgtccagttcttccaccagtggataatccagcaccgcttcttccatcaaccagccgcgcacaatcgcatggtaacgtttctggatttggtgctgttcaaactgttgtgccagcagccgtccggcctcgctggataatcccatcaacaacacaccagaagtgggtcggtccagacgatgagcagtaaaaacatgctggcctatctggtcacgcacggtttgcatgaccactactttctcgtcgcgatccagccagctgcggtgaaccagccagccggagggtttatttaccgcaaccagccattcatcctgatagagtatttccagcattagctcgcatcatccgcaaaaagagcatccagtttttccagctcagccagaataagcgcgcgttgcggatggtccgtcgccagcgccatttcataatagggtgcaacggcaaaagcgcccggtaacggctgtttgttatctaacaaatcgtgcattcgcgggatcagcacccactgcaaccactccagtggttccatggtgtccataaagaacggttgggtactattaaattgatgcggctggggttcatcgtttcgccagtgctgatgttcacgcagtaacgcttcaagcgcctgcaactggagacgaacgcggtcatgagtggtcataaagcaacctcaataagaaaaactgccgcgaaggatagcaggaataaaaaaagggagcactgtattcacagcgctcccggttcgtttcgcagcattccagctacttttgttgctccctgctcatccttgacaacttttcctctggccttgcggccaatcgttcatcctgaactattgcttcctgctcacaccaccccgatgtgatacttcatcctgaagtgtccctggccttcctgacccaccgaatcatcctgaccggttctcattctccatcctggaggtgtcctttaacgcgtcctgcgtcatcctcttcgcttcatccagaagcctttccctgaaacaccatcctggtgtgtcctgcagaagtgtcatcatcctgatgttcacttcgttgtctgactccctgtcgacgaagatagaatcgtctttttcgcgaagtcttacaaggcgcttacagacaatgccttaaggaaaatttcatatgaaagttaagaattaacaatcaacattttgattttaaatgaaaataacgattcttatctttttaagtattcgcttatttcctggcgatctcctacagagtctgtaagagatctctcacaaccagatggggtatttggattacagaagaggcttaagttgattaaggaattccgcaagatttgaggctaaatgcgtccgtttacgtgttcccagcgtctctttgcacacttcaccggagagattacacaccgagatgacctctaactcttcttccagcgtcgcgataaatagtgtgggcggcagttttagccttttctgagtcaccagatgaccaatcagattttcctgcacccgacggaagtcgtcttcactccaggtttgcagcaatgtcagtttgatatcgccaaactgcgcgtgcatatccccggcaaactgagtcgtataaaaggtatgaattgtgggttgtatcacaatatcaaaagcgcgttcaaccgcgtttacattttgttccccggtaaacggctggggttgccagtatacggcatcttcggtagttgaaataatgcacggtgaaggaacaccgtacagttcctcacttaacggccagcttttatgctcttcatgccacgcatcgcagtagcgtgcagtaaaatctttcagggcttgtgcggtcaaatcgtccactaatttctctcttcacttaaaccagatacacttgtcgtttagtttatctggtttatgacggtgaaacatgtcttcttatgcaaaccatcaggcacttgcgggcctgactcttggaaaatcaaccgattaccgggatacctatgacgccagcctactgcaaggcgttccacgcagcctgaatcgcgacccgctgggtctgaaagcggataacctgccttttcacggtacggatatctggacgctgtatgaactttcctggctgaatgcgaaaggtttgccgcaggtcgctgtcggtcatgttgaacttgattacaccagcgtaaatctgattgagtcgaagagttttaagctctatctcaacagttttaaccagacgcgttttaataactgggatgaggtgcgccagacgctggagcgcgacttaagcacttgcgctcagggtaagattagcgtggcgttatatcgtcttgatgaactggaaggccagccgataggtcattttaatggcacttgcattgatgaccaggatatcactatcgataactatgaattcactactgactatctggagaatgccacctgtggtgaaaaagtagtggaagagacgcttgtcagccacctgctgaaatcaaactgcctgatcacccatcaaccagattggggttcgctccaaattcagtatcgtggacgccaaattgacagagaaaaactgctgcgttacctggtctcattccgtcatcacaacgagttccacgaacagtgcgtggaacgcatctttaatgacctgttacgcttctgccagccagaaaaattgagcgtttacgcacgttatacccgtcgtggcggtctggacattaacccgtggcgcagtaatagcgattttgtcccatcgaccacaagactggttcggcaataaattttttctcaattttgcgtgctggattcacgcagaaggttgtgaaaggtcatcaggcagggctattgtaatcaaagggaatgacgatattcgtcccataaggagtttttcttgattacacatattagcccgcttggctccatggatatgttgtcgcagctggaagtggatatgcttaaacgcaccgccagcagcgacctctatcaactgtttcgcaactgttcacttgccgtactgaactccggtagtttgaccgataacagcaaagaattgctgtctcgttttgaaaatttcgatattaacgtcttgcgccgtgaacgcggcgtaaagctggaactgattaatcccccggaagaggcttttgtcgatgggcgaattattcgcgctttgcaggccaacttgttcgcggtcctgcgtgacattctcttcgtttacgggcaaatccataacaccgttcgttttcccaacctgaatctcgacaactccgtccacatcactaacctggtcttttccatcttgcgtaacgctcgcgcgctgcatgtgggtgaagcgccaaatatggtggtctgctggggcggtcactcaattaacgaaaacgagtatttgtatgcccgtcgcgtcggaaaccagctgggcctgcgtgagctgaatatctgcaccggctgtggtccgggagcgatggaagcgccgatgaaaggtgctgcggtcggacacgcgcagcagcgttacaaagacagtcgttttattggtatgacagagccgtcgattatcgccgctgaaccgcctaacccgctggtcaacgaattgatcatcatgccagatatcgaaaaacgtctggaagcgtttgtccgtatcgctcacggtatcattatcttccctggcggtgtgggtacggcagaagagttgctctatttgctgggaattttaatgaacccggccaacaaagatcaggttttaccattgatcctcaccggcccgaaagagagcgccgactacttccgcgtactggacgagtttgtcgtgcatacgctgggtgaaaacgcgcgccgccattaccgcatcatcattgatgacgccgctgaagtcgctcgtcagatgaaaaaatcgatgccgctggtgaaagaaaatcgccgtgatacaggcgatgcctacagctttaactggtcaatgcgcattgcgccagatttgcaaatgccgtttgagccgtctcacgagaatatggctaatctgaagctttacccggatcaacctgttgaagtgctggctgccgacctgcgccgtgcgttctccggtattgtggcgggtaacgtaaaagaagtcggtattcgcgccattgaagagtttggtccttacaaaatcaacggcgataaagagattatgcgtcgtatggacgacctgctacagggttttgttgcccagcatcgtatgaagttgccaggctcagcctacatcccttgctacgaaatctgcacgtaatctccgctcccccggtgacgtttgttgccgggttttctcgtttttggtcacttactcatcaactcatttcatttgttatatgaatgtttcttaccaccctcacgcgacaaatatcatcacagttaatatgtcatacaatttatgttgcaacgcaaacgtttccctattttcataaaccgtattttatcgctatgaaaaagaaattatcgccatgattaactaaaagtattgattttttcagttcaacctacatatattgcgcgccccggaagaagtcagatgtcgtttaatgggcaaatattgcccttaaattctcttttacttttgatttacagagtaaagcgttgggataatctatcttccaagtagattattgtatttgagatcaagatcactgatagatacataacttgtgtgtatctttccgccctcaaattattacggcggtaaatgattaagccatcgccgatagacagatttcatttttacggtcaggcaccttcccgggctgaactggctaaaagctgaattatttgcattcctccaggagaaatagatggaaacgactcaaaccagcacgattgcgtcgaaagactctcgtagtgcctggcgcaagacagacaccatgtggatgctgggcctttacggcacggcaatcggcgcgggcgtgctgttcctgccaatcaacgccggtgttggcggtatgatcccgctgatcatcatggctatccttgcgttcccgatgacgttttttgctcaccgcggcctgactcgcttcgtactgtctggtaaaaacccgggcgaagacatcaccgaggttgtagaagaacactttggtattggcgcaggtaaactgattaccctgctctacttcttcgctatctacccgatcctgctggtttatagcgtggcaatcaccaataccgttgaaagcttcatgtctcaccagctgggtatgacgccaccgccgcgtgcgattctgtcgctgatcctgatcgtgggtatgatgaccatcgttcgcttcggtgagcagatgatcgttaaagcgatgagtattctggtattcccgtttgttggcgtactgatgctgctggctctgtacctgatcccgcagtggaacggcgctgcactggaaacgctgtctctggacactgcatctgcaaccggaaacggtctgtggatgaccctgtggctggcaattccggtaatggtgttctcgttcaaccactctccgatcatctcttctttcgccgttgcgaagcgtgaagagtacggcgatatggcagaacagaaatgctcgaagatcctggcattcgcacacatcatgatggtgctgaccgtaatgttcttcgtcttcagctgtgtactgagcctgactccggcagacctggctgcggctaaagagcagaacatctcgattctgtcttacctggctaaccactttaacgcaccggttatcgcgtggatggctccgattatcgcgattatcgctatcaccaaatccttcctcggtcactacctgggcgcacgtgaaggcttcaacggtatggtgattaaatctctgcgtggtaaaggtaagtctatcgaaatcaacaagctgaaccgtatcactgcgctgttcatgctggtaacgacctggattgttgccaccctgaacccgagcatcctgggtatgattgaaaccctgggcggtccaatcatcgcgatgatcctgttcctgatgccgatgtacgcaattcagaaagtaccggcaatgcgtaagtacagcggtcacatcagcaacgtattcgttgtcgtgatgggtctgattgcaatctccgcaatcttctactctctgttcagctaagtcctttcgcgccgctttcgggcggcgcttcctccgttttaacgcgatgtatttcctatgattagcgtattcgatattttcaaaatcggcattggcccttccagttctcataccgttggaccaatgaaagcgggtaaacaatttaccgacgatctgattgcccgtaacctgcttaaagacgtgacccgcgtggtggttgacgtgtacggctcgctctctctgaccggtaaaggccaccacactgatatcgccattattatgggcctggcgggtaacctgccggataccgtggatatcgattccatccccagttttattcaggatgtgaatactcatggtcgcctgatgctggcaaacggtcagcatgaagtggagttcccggttgatcagtgcatgaacttccacgccgacaacctttctctgcatgaaaacggtatgcgcattaccgcgctggcgggcgataaagtcgtttacagccagacttactactctattggcggtggctttatcgttgatgaagagcattttggccagcaggatagcgcaccggttgaagttccttatccgtacagttcagcagccgatctgcaaaaacattgtcaggaaaccgggctgtcactctctggcctgatgatgaaaaacgagctggcgctgcacagcaaagaagagctggaacagcacctggcgaacgtctgggaagtcatgcgcggcggtattgagcgcggtatttccaccgaaggcgtgttgcctggcaaactgcgcgttccacgccgtgctgcggcactacgccggatgctggtcagccaggataaaaccaccactgacccgatggcggttgttgactggatcaacatgtttgcactggcagtgaacgaagagaacgctgctggcggtcgcgtggtgactgcgccgactaacggtgcgtgcgggattatcccggcagttctggcgtactacgacaagtttatccgcgaagtgaacgctaactcactggctcgttacctgctggtagccagcgccattggttctctttataagatgaacgcgtcgatttctggtgctgaagtgggttgccagggtgaagttggcgtggcgtgctcaatggcggcggctggtctggcagaactattaggcgcaagcccggcgcaggtgtgcatcgcggcggaaatcgccatggagcacaacctcggtctgacgtgtgacccggtcgccggacaggtacaggtgccatgcatcgagcgtaacgccattgcggcagtaaaagcggtgaacgccgcacgtatggcgctgcgccgtaccagcgagccgcgcgtctgcctcgataaagttatcgaaaccatgtacgaaacaggtaaagatatgaacgccaagtaccgcgaaacctctcgcggcggcctggcaatgaagatcgttgcctgcgattaatcgctctccaaaggcctcgttttgcgaggcctcttcccgatttctcatccagccgtagcctgttccggcatcgaatgttacccttatcgcctgatctttaagggggttatcgtggctgttcatttgcttattgtcgatgcactgaatcttattcgtcgcattcatgccgttcaggggtcgccctgtgtcgaaacctgccagcatgcgctcgatcagctcattatgcacagccagccaacccacgcggtcgccgtttttgatgatgaaaaccgcagtagcggctggcgtcatcagcgtttaccagattacaaagcgggtcgaccgccaatgccggaagagttgcacgacgagatgcctgcattacgcgccgcctttgagcaacgcggcgtcccgtgctggtcaaccagcggcaacgaagccgatgacttagccgccacgctggcggtcaaagtgacacaggccgggcatcaggcaacgattgtttcgacagataaaggctactgtcagttactttcaccgacattacgtattcgtgattacttccagaaacgttggctggatgcgccatttatcgataaagaatttggcgttcaaccgcagcagttgcccgattactggggacttgcggggatcagcagttcaaaggtaccgggtgttgcgggaatcggaccaaaaagcgccacgcagctgctggtcgagtttcagagtctggaagggatatatgagaatctggatgcggttgccgaaaagtggcgcaaaaaattagaaacccataaagagatggcgtttctgtgccgcgatattgcccgcttacaaaccgatttgcatatcgacggcaatttacagcaattgcggttggtacggtaacggcgagccggatacgccgcaaacgtcgtatccggcattatcacatcagcgcatttaccaggcggtatggtaaagctctacaatatcctcaagcgttgcttcacgcgggttgccaccggtacaaacatcatccagtgccgcctgcgccagtgccggaatgtcttccttgcgtacaccaacatcacgcaaatgtggcggaataccgacatcacggttgagagcaaacaccgcttcaacagcggcattacgcgcctcttccaggctcataccttccactttcacgcccataacgcgcgcgatatcgcggtacttctcaccggtaaagtcagcgttataacgcatgacatgcggtaacaggatggcgttcgcaacaccgtgtggagtgttataaaacgcgcccagtggatgcgccataccatgcaccaaccctaacccaacattcgagaagcccatacccgcaacatactgcccgagcgccatttcttctccggcatccttatcaccagcaaccgatcctcgcagcgccccagcaatgatttcaatcgctttaatgtgcagtgcatcggttagcgcccacgcgccacgggtaatatacccctcaatagcatgagtgagcgcatcgacacccgtcgcagctttcagcgctggaggcataccatccatcatgtcagcgtcaataaacgccacctgcgggatatcatgcggatcaacgcaaacaaacttgcgccgtttctcttcgtcagtgatcacgtagttaatggtcacttctgccgcagtacctgctgtggtaggaattgccagaatcggtacactgggtttattggtcggggaaagcccttccaggctacgcacatcggcaaactccgggttgttgctgataatgccaatcgctttacaagtatcctgtggagaaccaccaccaatagcgatcaggtaatccgcgccgctattctggaatacaccgagcccttctttgacgacagtaattgttgggttgggcactacgccgtcgtaaatcgcccatgccagccctgcagcatccatcttatcggtcactttcgccaccacgccgcattgcaccagcgttttatcggtgacgatcagcgccttctgataaccacggcgtttcacctcatcggttaaagccccaacagcaccccgaccaaaccatgccgtttcgttcagaatcattctgttagccatcatccttctccttgttgctttacgaaattactcttcaattcgtaacccataggttttgaatttctccagcactacggcaatctcttcatcgctcagcactggcaccgggtccgtaatcgccagggtcgtcaggtaaagttgcgccagcacttcaacttcatgcgccagccataacgctttttccagattcacctcacaagcgataagcccatgatgttgtaacaaagttgccttacgatttttgagagccagcgcaacatgttcagaaagttcgcgtgttccaaaggtcgcataaggcgcgcaaggaatagaattaccgccagccgccgcaatcatgtagtgaatagcggggatcgatcggttaagaatggaaactgccgtgcaatgaacggcatgattgtgaacaaccgcgttggcatccggtctgctttgataggctgccatatggaaacgccattcgcttgaggggagctttccttcctcatgtttaccgttgccatcaataaagacaatatgcgactccgtcagtttttcatatggaatgcctgtaggcgtaatcagcatcccatcctgataacgtacactgacgttccccgctgtcccctggttcagtcccaggcgggtcatttccaggcaagtgtcaataatctgacgagcaagtttatttcgttccattagctacctctctctgattcaaaacagggcaataatgttgttcctttcacactattgaattagccgtttaattacccaccatcttcttcctgattaacaagaaagaaattcacaagcttatattttgtgacctggttcaactaatcacagtaaataactgcaagttctctttttataaccccattaaaaatgaccgctcttaaaaatatttatcaaaacggtcatttttctattcctccaagcccggaatgaccgttttcggcacaaacaattaatacggtcatctgatttgtgttttttatgatttattttctgaaacgggcatgaaatttcgattattaaagtgatggtagtcacataaagtcaccttctagctaataagtgtgaccgccgtcatattacagagcgttttttatttgaaaatgaatccatgagttcatttcagacaggcaaatattcactgatatgaagcccgaactcgctggttttgcacttttgaaaacataaccgattacgtgcttaagcttctgaacctaagaggatgctatgggaaacacatcaatacaaacgcagagttaccgtgcggtagataaagatgcagggcaaagcagaagttacattattccattcgcgctgctgtgctcactgttttttctttgggcggtagccaataaccttaacgacattttattacctcaattccagcaggcttttacgctgacaaatttccaggctggcctgatccaatcggccttttactttggttatttcattatcccaatccctgctgggatattgatgaaaaaactcagttataaagcagggattattaccgggttatttttatatgccttgggtgctgcattattctggcccgccgcagaaataatgaactacaccttgtttttagttggcctatttattattgcagccggattaggttgtctggaaactgccgcaaacccttttgttacggtattagggccggaaagtagtggtcacttccgcttaaatcttgcgcaaacatttaactcgtttggcgcaattatcgcggttgtctttgggcaaagtcttattttgtctaacgtgccacatcaatcgcaagacgttctcgataaaatgtctccagagcaattgagtgcgtataaacacagcctggtattatcggtacagacaccttatatgatcatcgtggctatcgtgttactggtcgccctgctgatcatgctgacgaaattcccggcattgcagagtgataatcacagtgacgccaaacaaggatcgttctccgcatcgctttctcgcctggcgcgtattcgccactggcgctgggcggtattagcgcaattctgctatgtcggcgcacaaacggcctgctggagctatttgattcgctacgctgtagaagaaattccaggtatgactgcaggctttgccgctaactatttaaccggaaccatggtgtgcttctttattggtcgtttcaccggtacctggctcatcagtcgcttcgcaccacacaaagtcctggccgcctacgcattaatcgctatggcactgtgcctgatctcagccttcgctggcggtcatgtgggcttaatagccctgactttatgcagcgcctttatgtcgattcagtacccaacaatcttctcgctgggcattaagaatctcggccaggacaccaaatatggttcgtccttcatcgttatgaccattattggcggcggtattgtcactccggtcatgggttttgtcagtgacgcggcgggcaacatccccactgctgaactgatccccgcactctgcttcgcggtcatctttatctttgcccgtttccgttctcaaacggcaactaactgaacatattttccgaataaagtgaggaatctgtaatgaaaaaaatcagcttaccgaaaattggtatccgcccggttattgacggtcgtcgcatgggtgttcgtgagtcgcttgaagaacaaacaatgaatatggcgaaagctacggccgcactgctgaccgagaaactgcgccatgcctgcggagctgccgtcgagtgtgtcatttccgatacctgtatcgcgggtatggctgaagccgctgcttgcgaagaaaaattcagcagtcagaatgtaggcctcaccattacggtaacgccttgctggtgctatggcagtgaaaccatcgacatggatccaacccgcccgaaggccatttggggctttaacggcactgaacgccccggcgctgtttacctggcagcggctctggcagctcacagccagaaaggcatcccagcattctccatttacggtcatgacgttcaggatgccgatgacacatcgattcctgccgatgttgaagaaaaactgctgcgctttgcccgcgccggtttggccgtcgccagcatgaaaggtaaaagctatctgtcgctgggcggcgtttcgatgggtatcgccggttccattgttgatcacaacttctttgaatcctggctgggaatgaaagtccaggcggtggatatgaccgaactgcgtcgccgtatcgatcagaagatttacgacgaagccgaattggaaatggcactggcctgggctgataaaaacttccgctatggcgaagatgaaaataacaaacagtatcaacgtaatgccgagcaaagccgcgcagttctgcgcgaaagtttactgatggcgatgtgtatccgcgacatgatgcaaggcaacagcaaactggccgatattggtcgcgtggaagaatcacttggctacaacgccatcgctgcgggcttccaggggcaacgtcactggaccgatcaatatcccaatggtgacaccgccgaagcgatcctcaacagttcatttgactggaatggcgtgcgcgaaccctttgtcgtggcgaccgaaaacgacagtcttaacggcgtggcaatgctaatgggtcaccagctcaccggcaccgctcaggtatttgccgatgtgcgtacctactggtcaccagaagcaattgagcgtgtaacggggcataaactggatggactggcagaacacggcatcatccatttgatcaactccggttctgctgcgctggacggttcctgtaaacaacgcgacagcgaaggtaacccgacgatgaagccacactgggaaatctctcagcaagaggctgacgcttgcctcgccgctaccgaatggtgcccggcgatccacgaatacttccgtggcggcggttactcttcccgcttccttaccgaaggcggcgtcccgttcaccatgactcgtgtcaacatcatcaaaggcctgggaccggtactgcaaatcgcggaaggctggagcgtggaattgccgaaggatgtgcatgacatcctcaacaaacgcaccaactcaacctggccaaccacctggtttgcaccgcgcctcaccggtaaagggccgtttacggatgtgtactcggtaatggcgaactggggcgctaaccatggggttctgaccatcggccacgttggcgcagactttatcactctcgcctccatgctgcgtatcccggtatgtatgcacaacgttgaagagaccaaagtgtatcgtccttctgcctgggctgcgcacggcatggatattgaaggccaggattaccgcgcttgccagaactacggtccgttgtacaagcgttaatacattactccctgatgtgatgcccggtcgctccggctaccgggcctgaacaagcaagagtggttagccggataagcaatgttatccggctatattgcaggagcgattatgaaacaagaagttatcctggtactcgactgtggcgcgaccaatgtcagggccatcgcggttaatcggcagggcaaaattgttgcccgcgcctcaacgcctaatgccagcgatatcgcgatggaaaacaacacctggcaccagtggtctttagacgccattttgcaacgctttgctgattgctgtcggcaaatcaatagtgaactgactgaatgccacatccgcggtatcgccgtcaccacctttggtgtggatggcgctctggtagataagcaaggcaatctgctctatccgattattagctggaaatgtccgcgaacagcagcggttatggacaatattgaacggttaatctccgcacagcggttgcaggctatttctggcgtcggagcctttagtttcaatacgttatataagttggtgtggttgaaagaaaatcatccacaactgctggaacgcgcgcacgcctggctctttatttcgtcgctgattaaccaccgtttaaccggcgaattcactactgatatcacgatggccggaaccagccagatgctggatatccagcaacgcgatttcagtccgcaaattttacaagccaccggtattccacgccgactcttccctcgtctggtggaagcgggtgaacagattggtacgctacagaacagcgccgcagcaatgctcggcttacccgttggcataccggtgatttccgcaggtcacgatacccagttcgccctttttggcgctggtgctgaacaaaatgaacccgtgctctcttccggtacatgggaaattttaatggttcgcagcgcccaggttgatacttcgctgttaagtcagtacgccggttccacctgcgaactggatagccaggcagggttgtataacccaggtatgcaatggctggcatccggcgtgctggaatgggtgagaaaactgttctggacggctgaaacaccctggcaaatgttgattgaagaagctcgtctgatcgcgcctggcgcggatggcgtaaaaatgcagtgtgatttattgtcgtgtcagaacgctggctggcaaggagtgacgcttaataccacgcgggggcatttctatcgcgcggcgctggaagggttaactgcgcaattacagcgcaatctacagatgctggaaaaaatcgggcactttaaggcctctgaattattgttagtcggtggaggaagtcgcaacacattgtggaatcagattaaagccaatatgcttgatattccggtaaaagttctcgacgacgccgaaacgaccgtcgcaggagctgcgctgttcggttggtatggcgtaggggaatttaacagcccggaagaagcccgcgcacagattcattatcagtaccgttatttctacccgcaaactgaacctgaatttatagaggaagtgtgaaatgctgaaaacaatttcgccgttaatttctcccgaactattgaaagtgctggcagagatgggacatggagatgaaattattttttccgatgctcactttcccgcccattcgatgggaccgcaggtgatccgcgctgatggcctgttggtgagcgacttgctccaggcgattatcccgttatttgaactggacagttatgcaccgccgctggtgatgatggcggcggtagaaggtgacactctcgatcctgaagtagaacgacgttaccgtaatgcgctttcactacaagccccgtgtcctgacatcatccgcatcaatcgttttgcgttttatgaacgggcgcaaaaagcctttgcgatcgttatcacaggcgaacgagcgaagtacgggaatattcttttaaaaaaaggggtaacaccgtaatctcataccggtacgcccgcatgacgcgggcggttatcgaatgatggggtgaaaaatatgaaagcggcacgccagcaagcgatagtcgacctgctgctgaaccataccagcctgaccacggaagctctctctgaacagctaaaggtcagtaaagaaaccattcgtcgcgatctcaatgaattacagacgcagggtaaaattctgcgcaatcatggacgcgctaaatatatccaccgtcaaaatcaagacagtggcgatccctttcacatcaggctgaaaagccattatgcgcataaagcagatatcgcgcgcgaggcgctcgcgtggattgaagaagggatggtgatagccttagacgccagttcaacttgctggtatctggcacgccagttgcctgacatcaacattcaggtcttcaccaatagccatccgatttgccatgaactcggtaaacgcgaacgcattcaactgatcagttccggcggcacacttgagcgcaaatatggctgttacgtcaatccctcgctgatttcccaacttaaatcgctggaaatcgatctgtttattttttcttgtgaagggatcgatagcagcggcgcactgtgggactccaatgcgatcaacgctgattacaaatcgatgctattaaaacgtgccgcgcaatcgttgttattgattgataaaagtaaatttaatcgttcaggggaagcccgcatcgggcatctggatgaggtaacgcacattatttctgatgagcgccaggttgcaacttctttggtaacagcctgacggaaagggtagcaggccggagacgacgccccggccttgcctgttatcgctcgtcgcgacgaccacccaccgcagcccagatgcggcggacgtgcaccgtcacttcttcgcgatcgtgatacaactgccgcgcctgaatctgagcatttatgccatgttcatcaagctgtgcctgaatatacgccagattgtgtgacacttcttcgtagcgttttttcatcggcagtttgaggttgaaaatggtttcacggcaccagccattaaccagccactgcgccatcaatgccgcaactttcgccggtttttcaaccatatcgcataccatccaggagatattgctgcgcgtcggacggaatttgaaaccgtcttcccgcagccacgtcacctgtccggtatccatcagactttgcgccatcgggccgttgtcgacggaataaacccacatgttgcgcttcaccagttggtaggtccagccgccagggcaagcgcctaaatccaccgcccacatcccgttcgccaggcgttcatcccactcatccgcaggaataaacacatgaaatgcctcttccagtttgagcgtggaacgactcggcgcatctgccggaaatttcaggcgcggaatgcccatatagaacggcgaattattgttgctgtatgagtaaccggtatagcagcagcctggtgcaataaagaatacatgcacaaccggacgcttcggcgtttcatagttcgccagcaccccggcatcgcgcaaggcagcgcgtagcggaacagtaaatttacggcagaatttcagtaactctttgctttcgttggtatcggcaacttcaacacgcagttcaccgcccttctctactacgccctgtaacatgccgacaatgggggtaatacgatcttctggcggcaaatgctgcaggagttcccccaccacaaaccactggcgggcaaaaattaatgaactgaacggcagctcacggattaacttatcgccatcatcaggttgataacattcataaatgacataacccgcattctctttcacgcgggcaaaaccgaaaatttcccgctggccggctttatcggtaatttctgcggcgcactctttttcaaagcccggacggcacagcaatacaaccttattcatgacttacgcccttgcgctttaaacggatagcaccaactaacattaacgcccagcccgcgaggaagctcacgccgccaaccggagtgacaaacgcccacaaacgcagatgggacagcgccaggcaataaaggctgccgctgaacaacaccgtgcctaacgcgaggaaaacgctactccagtaaaaccagatactgatgcgacgctgcattgccaccgccagacctaagatcgccagcgtatgaaacgcctggtattcgaggccggtctggatccagcccatctcaacggcccccatggttttacttaacacatgcgcgccaaaagcgcccagagccacaaaaatgaagccgctaatggcggcgaaaatcagcataaaacggctggtcatggtcgtaccctacgtaaattattgttcataacgaaagcggaatttttcttgttcagcagcggctttcgccaggatccattggcgaaaggcggctattttacccagttctgcctgactgtcatgacaaaccagataaaaagcatttttactgaccagaacatcattaaacgggcaaacaagacgtccggcctcgatttcagattgcgccatcacgttatttgccagcgccactccctgcccgtggatagccgcttgcagcaccatggcgctatggctaaaaattggcccttgctgaacgttgatatgatttaaccccaactgtcgggtatatgtctgccagtcacggcgcgaagcatcatgtaataacgtatgtttagccagatcttccggtgtcttcaagggtttttcgccagtcagcagtagcggcgaacacaccggcaataaatattcggcgtacagtttttccacccgtagccccggccagttgccccgaccataaaatatcgccacatcaacatcatccgccagcttatcttcctgacgatcaaccgcctggattcgaacgtcaattcccggataagctgaattaaagctggaaagtcgcggaaccaaccaatgaatggcgaaactggggagtaaactgaccgtcaacgcccccttggcgctacgggcctggagtttacgcgtcgcttcggttaattgcgaaaatatctctttgatatcgaggaaatagctttgcccttcctcggtcagcaggagtgaacgattacggcggcggaacagttttagccccaaaaaatcctcaagagacttgatttgatgacttactgcggcttgggtcacaaaaagctcttctgctgcgcgagtgaaacttaaatggcgtgctgcggcatcaaaaactcgtaaggcatttagcggtggtaatcgtttagacatggctattaaactttgatgttaaatgaatttaacaattagatcacactatgtaacctattagtttttttaatctgagccattataaattgtccgttgagcttctaccagcaaatacctatagtggcggcacttcctgagccggaacgaaaagttttatcggaatgcgtgttctggtgaacttttggcttacggttgtgatgttgtgttgttgtgtttgcaattggtctgcgattcagaccatggtagcaaagctaccttttttcacttcctgtacatttaccctgtctgtccatagtgattaatgtagcaccgcctaattgcggtgcttttttttaccttgcgatcgcgaattactgatccagttcgaccatctctttcacgtcagtacggttgatctgctgtttgttgccattagcgtctttatacgaaatcataccggtatcgttatcagtctgtggtttgccgtcagagacgatggtacgtccgtcattggtgtgcatcacatagttcgaaccggaacaggcgctcagggcaaaagtcagcatacaggcagaaataattgcggcagtctttttcatcatcttctccttaaagcgattaataaatcttaatagtattgattaacaggctaaaattaacgcctaacactattcagcatatgttacttacgcggcttcgccaggatatccagataattctgatggttagcactctccttgtatcaaagtgaattttgcgtcacgatcggtgcatcaagccgaggagtaccatgaacgtttttaatcccgcgcagtttcgcgcccagtttcccgcactacaggatgcgggcgtctatctcgacagcgccgcgaccgcgcttaaacctgaagccgtggttgaagccacccaacagttttacagtctgagcgccggaaacgtccatcgcagccagtttgccgaagcccaacgcctgaccgcgcgttatgaagctgcacgagagaaagtggcgcaattactgaatgcaccggatgataaaactatcgtctggacgcgcggcaccactgaatccatcaacatggtggcacaatgctatgcgcgtccgcgtctgcaaccgggcgatgagattattgtcagcgtggcagaacaccacgccaacctcgtcccctggctgatggtcgcccaacaaactggagccaaagtggtgaaattgccgcttaatgcgcagcgactgccggatgtcgatttgttgccagaactgattactccccgtagtcggattctggcgttgggtcagatgtcgaacgttactggcggttgcccggatctggcgcgagcgattacctttgctcattcagccgggatggtggtgatggttgatggtgctcagggggcagtgcatttccccgcggatgttcagcaactggatattgatttctatgctttttcaggtcacaaactgtatggcccgacaggtatcggcgtgctgtatggtaaatcagaactgctggaggcgatgtcgccctggctgggcggcggcaaaatggttcacgaagtgagttttgacggcttcacgactcaatctgcgccgtggaaactggaagctggaacgccaaatgtcgctggtgtcataggattaagcgcggcgctggaatggctggcagattacgatatcaaccaggccgaaagctggagccgtagcttagcaacgctggcggaagatgcgctggcgaaacgtcccggctttcgttcattccgctgccaggattccagcctgctggcctttgattttgctggcgttcatcatagcgatatggtgacgctgctggcggagtacggtattgccctgcgggccgggcagcattgcgctcagccgctactggcagaattaggcgtaaccggcacactgcgcgcctcttttgcgccatataatacaaagagtgatgtggatgcgctggtgaatgccgttgaccgcgcgctggaattattggtggattaatgacaaacccgcaattcgccggacatccgttcggcacaaccgtaaccgcagaaacgttacgcaataccttcgcaccgttgacgcaatgggaagataaatatcgccagttgatcatgctggggaaacagcttccggcattgccagacgagttaaaagcgcaggctaaagagattgccggatgcgaaaaccgcgtctggctgggatatacagtggctgaaaacggcaaaatgcatttctttggcgacagcgaagggcgcattgtgcgcggcctgctggcggtgttgttgactgccgttgaggggaaaaccgccgccgagttgcaggcacagtcaccactggcattgtttgatgagctgggattacgtgcgcagcttagcgcctcacgcagccaggggttaaatgcgttaagcgaggcgattatcgctgcgacgaagcaggtttaagcacagaaccgggtcggataagacgttcgcgtctcatccgacctgattgtttaaccctgacgcgccgctttcgccatcatcttcttcagcgcatgagaaaccgcaacaaacccaaaggtggcggtcaccatcgttgccgcgccaaatccagatgcacaatccatccgcttcggcccttctgccgtggctttcatcgcacacaccgtaccgtctgactgcgggtacaccagcgcttcagtagaaaacacgcaatccacgccgagcttacctttactgtttttcactacgccaaaatcgcttttcaggcgctcgcgcaacttcgccgccagcgggtcctgaatcgttttcgccagatcggtaacctgaatctgcgtcggatcaatctgcccacccgcgccaccggttgtgaccagtgggattttattgcgccgacaataagcaatcagcgccgctttgggccgtacactatcaatggcatcaatcacgtacgaataacccacgctcatatactgcgctacgttatccggcgtcacgaaatcatccaccaccgttacacggcactccgggttaatctggcgaatacgctccgccataacttccgcttttgccagcccaacgttatcgcgcagggcatgaatttgccgattggtattggtgacgcacacatcatccatatcgataagcgtgattgcgccaatccccgtgcgcgccagcgcttccgccgcccaggaaccgacaccaccgataccaaccacacaaatatgcgcgtcagcaaacagttgcaacgctttttcaccatacagacgcgctgtgccaccaaaacgctgacgccatgcatcactaattaccacagacatagcacctcagaattaaaaagggcgaggttatccctcaccctaaacgcataaatgcctgatgcgctacgcttatcaggcctacataactcctgcaatattttggatttgcatgatttgtaggccggataaggcgttcacgccgcatccggcatgaacaacgcgcacttagtcaataatcaggatgtgaggttacccctcaccctgtcatatccgtaaaaacggcatacagaatatcacatcagccgctaaagacgttacctgcgcccggggcggttttcagcacccagacacgtccatagtggttgtaccaacctgcgcggtgtccggcttccggcccgatcccttgatagatatcgaagtgttggcctttgattgcaccaccgacatccagcgccaccatcagacgcagttcgtactgaccattaaatttgccgttattatccagcaacggcacttctgccagcaaggtagtacctggcggaataatggaacgatcagaggcaactgacgcgcgaccaaccagcggcaccgcacttgcccctttcaccggagcaaaagattgcggtttaaagaagacgaaagacgggttctgttccagcagctcgcgaacctcggcttcactgtgtgtttcgccccagtgacgaatcgcctgcatcgacatatcttcttttttcacttcgccacggtcgatcagcaccttaccaatgctgcgataggcatgaccgtttttccctgcatagctgaaaaagttaagcggactgccatcaccaaagtcgatatacccactaccctgcacatccataatgaagttatccatcagggagttactgtaagcgagaatatatttatcactcaatgcccccgcgtagatctccgcacgagacggcagacgaccacgttttggcggcatacggtaaataggatactggaactcgccctggcgggtatggcgcgcctgaattaccggcgtgtaataaccggtaaactgcacgttaccatagttgtcggcaccttccatctgccaggcatcaatgccgaactggcgcatattgcgggtatcaccgcctgcgcgcagccactcttgcaccgcgttataaacattactctggttgccatacagacgcggtgacgaattacggatatggttaatttgctcggcaaaatcaccggcgttaatcggcgcgccaacggcatctggctggttcaccagagagaaaggctgggtaaatttcccgtctttatattgctgtccgcgatcggttggtttggaagagcaggcggcaagcattgccacaaccgtgcccataagaaggtactttacccaacgtcctttcattgttctcttcttcaggttaaaaaataaggcgcaacgaagataacaaaccgccgcgtttaatgaaatgagcagcctctccctgacgcaaattttgcacaaaaaataggctttagtgatttgtttttgttcaaaatcatgccaaatccgtgatcggggtaaaaaaaaggttgcatgaaaacgcgagcggagtatagtgcgcatccacggacgcggggtggagcagcctggtagctcgtcgggctcataacccgaaggtcgtcggttcaaatccggcccccgcaaccaattaaaatttgatgaagtaaagcagtacggtgacgcggggtggagcagcctggtagctcgtcgggctcataacccgaaggtcgtcggttcaaatccggcccccgcaaccaatcaaatttgatgaagtaaaagcagtacggtgacgcggggtggagcagcctggtagctcgtcgggctcataacccgaaggtcgtcggttcaaatccggcccccgcaaccaattattgaacaccctaacgggtgtttttttgtttctggtctcccataaaaaagcgccattcagcgcctttttatcatccccttctcgccagcgtcgccccatcggcaaaatacgctttaatccccgcaagaatagactccgcaacttcctgctggaaagtcgccgttttcagtttacgctcttcctcaacgttactgataaacgccgtttcgaccagaatggagggaatatctggtgcctttagtacggcaaacccggcctgttcaacttgatttttatgcagcttgttgattttaccgagcttattcagtaccgctttaccaaacttcaggctgtcggcaatggtcagcgactgtaccatatcgaacatggtgtggtcgacatagcggtcaccgcttttgctcacgccaccaatcaagtccgaggcgttctgggtttgtgccagatattttgccgcagtactggttgcacctttggttgagagcgcaaacacagaggaaccgctcggctgacgactggtaaaggcgtcggcatggatagagacaaacaggtcagcacgctgtttctgggcttttgctacgcgcacttgcaatggaatgaagatgtcttcattgcgcgtcatgtacaccttcatattgccctctttctcgatcagagagcgcaaacggcgagctatttgcaataccacatctttttcgcgcgttttgtatttccccaccgcaccggagtcttcgccaccgtggccagggtcaagcataatgacaatcggacgatcgcgccctgctttacccggttgtggaccactttgcgctggcggcacctgcttttcgaggtcgcctttgttgtaatcctccagcagcgccagcagcgggtcctgcatatcctgtgcattggccggatagaggtccatcaccagacgctctttaaacccggcgaccggcgcaagggcaaacagctgcggttttacgttttgctttaattcaaaaaccatccgtacggtttgcgggtcaaattgcccgacgcgcgccgacttgatgaacgggtcgtctgcacgaatttgtgccgccatccccttgagtaccgagttcaggtttacatcttcgatatccaccaccacgcgttcagggttactcaacgcgaactgcttatatttcagctgacgatttgattccaccgtcacgcgggtgtagctggacgcaggccagacgcgcaccgccacgacctggctgaccgcagccagactgacctgacttacgctcaatagccacatggcacccgcgccttgcagtaaacgacgacggctgattgcagtgttggatcctgacatgcctctcccgagcaaaagaaatctaagctgtgtaacaagtaaacgactaatttgaccggaaactttagcgaaagacgcataatctgtcatctaataaacggtaaacattctttttatattcacggcattactgataaaaaagtcgctctcgcataaaatttacacttgcaccctgcgaaaaaacagaataaaaatacactaatttcgaataatcatgcaaagaggtgtgccgtggtaaaggaacgtaaaaccgagttggtcgagggattccgccattcggttccctatatcaatacccaccggggaaaaacgtttgtcatcatgctcggcggtgaagccattgagcatgagaatttctccagtatcgttaatgatatcgggttgttgcacagcctcggcatccgtctggtggtggtctatggcgcacgtccgcagatcgacgcaaatctggctgcgcatcaccacgaaccgctgtatcacaagaatatacgtgtgaccgacgccaaaacactggaactggtgaagcaggctgcgggaacattgcaactggatattactgctcgcctgtcgatgagtctcaataacacgccgctgcagggcgcgcatatcaacgtcgtcagtggcaattttattattgcccagccgctgggcgtcgatgacggcgtggattactgccatagcgggcgtatccggcggattgatgaagacgcgatccatcgtcaactggacagcggtgcaatagtgctaatggggccggtcgctgtttcagtcactggcgagagctttaacctgacctcggaagagattgccactcaactggccatcaaactgaaagctgaaaagatgattggtttttgctcttcccagggcgtcactaatgacgacggtgatattgtctccgaacttttccctaacgaagcgcaagcgcgggtagaagcccaggaagagaaaggcgattacaactccggtacggtgcgctttttgcgtggcgcagtgaaagcctgccgcagcggcgtgcgtcgctgtcatttaatcagttatcaggaagatggcgcgctgttgcaagagttgttctcacgcgacggtatcggtacgcagattgtgatggaaagcgccgagcagattcgtcgcgcaacaatcaacgatattggcggtattctggagttgattcgcccactggagcagcaaggtattctggtacgccgttctcgcgagcagctggagatggaaatcgacaaattcaccattattcagcgcgataacacgactattgcctgcgccgcgctctatccgttcccggaagagaagattggggaaatggcctgtgtggcagttcacccggattaccgcagttcatcaaggggtgaagttctgctggaacgcattgccgctcaggcgaagcagagcggcttaagcaaattgtttgtgctgaccacgcgcagtattcactggttccaggaacgtggatttaccccagtggatattgatttactgcccgagagcaaaaagcagttgtacaactaccagcgtaaatccaaagtgttgatggcggatttagggtaagcgatgaaaatcgtcggatgcgacatgcgtaacactcgtacgtcgcatccggcaattacgtttattcccgtgaactaaacaacgccgccagaccactgcgccgctcagtacgagtggcgattgccgcacttaatatgcgctcatcggcatacagcgacagacggcgacgcgcgcgggtcaccgcggtataaaccagctctcgcgttactaccggcgtgcgttggctcggcaaaatcaacgccgcatggtcgaactccgatccctgcgatttatgtaccgtcatcgcccacgtagtttcgtgctctggcaagcgactcggttgcacagacttaatattgccgtccggcatcgcaaaccagacgcgcgtcccctgcccgcgatccagcgcaataccgatatcgccattaaacaacccaagcgcgctgtcattacgggcaatcatcaccggtcgaccttcgtaccaacgagagtgcggatgacgatgaattttgcgcttctgttgcataaactgctcaattcgctcattcagtccagccacgccaaacggcccttcccgcagggcgcacaaaagctggtactcattgaacgcctgaatgattaaatccggctcggcacgcgcttgcagcagatccagataacgtccgtaacccgcaagagcttcctcaagcatcgcaatataatcttcgccgctctgtaaaagccgtttttcgatatcagtaaaatcctgctgaaaaacggttttcactgccgttttatcaccacggttgatcgccgcagctaactgaccaatgccagaatcgctgccgaaacgatagcttttttgcagcaggcagagactgtcgcgcaaagatgccgcttctgtgccggttcctgccggaacgtgagtccccgtcaggcggcttagctgcctggcacgctcggcggtaaagcccgcgttggcataagcgcagatatcgcccagcacagccccagcctcaaccgaggccagttgatcacgatcgccgagaaagatcactcgcgcatgatcgggcaaggcgtcgatcagtctcgacatcataggcagatcgatcattgacgcttcatctaccaccagcacatcaagatgcagcgggttaccggcatgatgacgtaaacgctggctacccggctgcgcgcccagcaatcggtgcaaagtgctggcatcttccggaatgcgtttcttttgttcatcggtcagcggtaactgtcgcaaagccttgccgagagattcggttaagcgcgcggcagctttacccgttggtgcagccagacggatacggcagcgttcgccgtcggccatttgaattaacgctgccagcaacttcgctacggtggtcgttttaccggtgccagggccgccggaaatcaccgagatccgccgcgtcagcgccactgccgccgcaactttttgccagttaatttcatcgcttactggaaaaagtttgtccagggtttgcgccagtagagcttcatcaacctcaatggcatgattcacttcgttgaaaaagcgtgccactgtgcgctcgttacaccacatgcgattcaaataaagacgatcgccacagaggatcatcggcgtgggttcatctcccctgctgaccgcttgagaagccagcaagcattcttcccaattttgtagctcaccgatttcactgacacaggtcgccaacagcggatgcgacgcctcgttattttccagtcgtgaaagcggcaaacaaacgtgtccctctccggcatcatgacttaacagtgccgccgcgagggtgacggcaggatgttcatctcccgccacggtcagggcaaattgcacatccagcgggcgtagctgtttgtgctccacagcttccagtaattgcttttgcaatttcattacgcctcctccagggtcataccggcaaacatctcatccatcagggcaatcaacccggcgttgggtcgggttgtgtaaatcccctgttgcggatgttctttatcaacgccacgcaggaacagataaataacgccgccaaagtggtgctcatagtcgtaatcagcaatgcgatggcgcagataacgatgcagcgccagggtataaagctgatattgcagatcatagcggtgtgcctgcattgccgctgccatagcctgttgggtgtaagccgaactgtcttcacccaaccagttggatttatagtcgagcaggtaataacgcccttcgtggcggaacaccaggtcgataaagccttttaacatgccacgtacctgcatgaactccagcggcgggcagcctgcggatagcgggtcaaactggcggattaacgtatcaagctgactggcgataagcggttcactaatcggcagataaaactccatctccacctgtttattgcgggcggaaagttgactcaggcttacgccggtttcattgagaggtgcctggaggacagccgtgatccactcggtcaataccggttcccactgcgattcaaagccgccgagttccagtttttcccgcacccagttcgggtcaaccggctgggtaaaatccaggtcttcaaacaaactgtgcaagaacgtccccggtgacgcaccgcgcggaaactgatgtggtgttaacgtcggttcttcaacgacgctggcaacgcctgcagcatcgacatccagccgaggcatcaaatcctgggcgataccgtgaccacgctgttgcaaaccagagtagctggtgacgcgccagttatcgccgggcaatcgttgtaacgtcttcgcattcagctctgctgtagaaacatcattaacctgccagggttggttatcaccagtttgtgccgtttgccaggcaatatcatcatcgcataacgcttcaatacaggtgcgaagccctgccgcatcttgcggttcccctttttgcagcaaacgcccgagcgcactttggtggacgtcggtgtcaccttttttatcgccacgacggcgcaccagcggtgcaacgccgagactgcaatgccaaaccgaacgtgtcagcgccacgtaaagcaaacgcagatcttccgccagacgttcggcctccgcgaggtcgacgctttctggcgcagcattaagatccagaactgcctcaaacgagtggcgatcgtgataaaacgcctgctcctggacgcggaaattggtgataaacggcagccagaccaatggatattccagccctttcgatttgtggatcgtgacaatctgcaccagatgtttatcactttcgagacgcatttgttggctggaggcattactgtctggctcgaggatatgttgcgataaccagcgtaccagcgcatgttcactttccagctgcgttccggcttcttgtagcagttcgctgatatgcaagatatcggtaagacgccgctcaccgcctgccgttgccagcaagttttcagcaatgttacgcgccgacatcagcgcccgcagcatcggcataacgccacgtttgcgccagatttgccgataaccatcgaactcttcgactaccacatcccacgcatgttcgtcattgttcagcgtttcgatatccagcgcgttcagccccatcattgacgttgccagcgcactacgcagggtgttctcacgttcgggcgtcatcaccgcctgcaacaaccaaagcatttcctgcgcttccagagtttcaaaaacactgtcgcggttcgaaaggtaaacggaagggatttccagcaacgttaaggcatcgcgcacctgggcggcctcctggcggctgcgcaccagcacactgatgtccgaagcacgcaccggacgcgcgtcgtcgccgttcatcagcaacgcttcgccccgctgtccggcttgtagccagtcgcggatttgcgcagcacatacctgcgccatggtactttgataatcgccaacgccgcagctttcgccttccatcagccacattttcatcgcaggctgtgtttcacctttaaatacaaaacgtaacgcctgatttttcccggctgatttcactggaataaacggtatttcgcgaaacatgaacgcgtcatcagtctggctgaaaagcttattcacgctgttcaccattcctggtgcggaacgccagttggtgtctaaagtgtagtgggcgtgaacttcgctacgcgccttcatataagtgaagatatccgcaccccggaatgcatatatggcctgcttcgggtcgccaattagcaacaatgcggtttccggctgatggtgccagatacggcgaaaaattcggtactgctgggggtcggtatcctgaaattcatcgatcattgccaccgggaatcgcgtacggatcgccgctgccaacacctcaccgctttcgctacgcagcgcggaatcgagccgacttaacatgtcatcaaaacccaattcgccacggcggcgtttttcacgcgctactgtttcgcggatctcagccaatgcgcgggtgatcaccagatcgcggatcgacaatggttctgcaagcagttgatcgatcgcctcaaacagtggatgtcgcggggtttcccccccggccttcgtgcgatcttctaagaaacgctgggagaatttttccagcgactccggcaactgataactgtttgtctcttcttctgcccaggcgctgatcttgtcgatccatttagcctgattgctacggttaaacttgcgtcgatcaataccagaagattcgatcagcgcatccagttcacccactgcgtcgcgccactgctgttttaccgtatcaatacgcgccacaatttgcgcgtgacgggaagccagcgtttcatcatcgggcggcggtgctttgataaccggcgcttcgccttgcagataacgattaatatcgcgcagcaacgcctgcggccctttccaggtttcaaagacgacctgggctatttcacgcggcagcgggtagcagtggcgacgccagaaatcggcgcaggcctggtagcgtagcagagactcatcttcaatcagctgctgctcaaacagcatgccggattcaaaggcattcaggttgagcatgcgctggcaaaagccgtgaatagtaaagactgccgcttcatccatctgccgttcggctaacaacaaccactgcgcggcttgcgctttatcgtcgatctcttccagcaggcgttcgtacagtggattgtcggtggtttcacgcagacaggcgatgcgcaactcgtggatattgctacggatacgaccgcgcaattctgccgtggcagcctcggtaaaggtgaccaccagcagttcttcaacggtcagcgggcggggaaaggcggcggaaccgcctagtccaagtaacaggcgcaaatagagcgccgcaatcgtaaaggttttgcctgtgccggcagaggcttcaatcaggcgctcaccctgtaagggcaagcgcaaaggatctagtgtctcggcgacatcactcattcttttcactcatcaggggcattgtttgctgcaacgcgctgacgttctcccacactttccagccttcagggtgtacatattcggctttcccgttctggctgccggaaatctgcgacagaatagccatgccttgcggctcgaccaccgcctgatggaagaaatcagcaagtttttgcggcgtcagcagttttatctgggccacgattttatcacgcgaatcgaagcgcatattgccgcgatcgaaatctttacttaacttcgatgcttcttcgccgagcgtttgcggtgcctgcagcatctgggtaattaccgcctgctggatttgcgcaaactcatctggcttcatcgctcgcaattttgcctctgcggttgggaaaaacgccttgtaacgctcccacaagaatgaaggctgtttatcattgctttgcaaaaggaagcccatgccccactgacgccccacgctcattggaaacgcaaacacggcatagcccaattgttcttcggtacgcaactgattgtagaaccacggctgtacgatctgccccaacagagagctataggctgagctggtgtattcatcgtagccagtcggtacaaataccgctgccagtgcggagtcggtgctgttaccggctttttcaaagatgacggattgttttttatcgaccactacatctttgtttcgacaccactctgaaccatcagcgcccaactgtttttgcacatcgcgtgccagcgttgttgcctgggcctcggtcatgttgccgataaccataaactctggtcgagcccctgattttaaggcgtcgcgataggccagcacctctttcaacgtaatggagggcaaaattttacgccgttcatctcgcgagaagtacggcacttgcgagagcatctgcgcgggcataatcgcctgctcaaacgctttacccttttctgcggaatccatcatctggttataccaggacttcgcctgctcaagctgatcttccgtagcggtatagctaaagtacccctcgagcaatgcctggaacagctgcggcagacgctgggtgtaaccattagcattaaccataaggccgttgttagcgttggtggaaaaacttatgccaccaaccgacgcctggttgcttaactgatcaagcgccagccctgcgagataatcattgagcgcaaacatcacctgattgcgggcgctgtccatggctttcggattacgcaaaatcaggctgacatcagctttgggctcgctggcaaaataacggcttggcgcatacaccacgcgcagattcgactcatcaacaatcagctctggatggtcgtatttcttctctgacttaatcagcgagaaatcatcaggaatataagggttaagctctggcaaagagagcgcaatgtcggcggcttttttctgccagtcggcgaaagtttgtgcgctgattttatcgacctgatacggcgcatcgacaaagtaagccgttttgttgtgcggctctttcgggctgatataccagatacgcgcattctgcggcgtcatcatcgccagacgttcctttactgctttagcatcgtaccgatcggcaatattgactgcatccagcgtatgctcaacaggaacgcgaatcatggtatctgccagccattcgacgtaatccatatcacgggtgatcgacggataacggaagtcgatatccagcacattcgccagttcatcgaagtattgtttatcaatgcctttttcacgtaacagattgagatagctaaaaattgccgccacaacctgatcgcgattagccaggcctttatcggttaaagacgcagagatcgctaatacgccgctgttgccgttgacgataggatcggagttggcgctaatgccctcaactaatccctgcttttgcagccagtcagaaagtgtacctgggctgcgattgccaatcagataggtaatcaattcatcggttttactacggaacttcgctgagttgttatcgatgcgaaactcaacgcgcaacactttacgcggcagcgcagggacgtaatgaatgataatgcccttttgcgcgtcggtgactaccggcacggtgatttccggttttttgctctctttgttcggcacgcgaccaaaggtgtccgccgccatttttgccaactccggcagcggtttattactgtaaataaccgccttcatcaaattggcggaatagtacttctcgtggaaatctttcagcgcctgctgcaccggattaccaggtttgtcgcttaaagtttcgaggttaccaccagaaaactttgaaccggggtgtgccgggttaatggtttctgcgctgacctgtgccatgcgcatcccgtcacgcgtacgcgccatggttaattcagcgttcaccgcattacgctcacgttcggcatatttcttgtcgagcaaaggttcagcaatagcatcggccaggcggtctaccgcaccaggcaaggcgtcgttctcaacttccagatagaaagccgtgcgatacggcgcagtgctggcattgtgactaccgccgtgcattttgagatattcggccagactgtcagcctgcgggtactttttcgaccccatcagactcatatgttcaaggtaatgtgccagcccctggtacgcctcgggatcttccagcgacccaacgggcaccaccagcgccgagagcgatttaactgcctgcggatcagaaaccagcaagaccaccataccgttatccagacgtatagcctgatactggcggttatctttatcacttttacggatggtttcctgaatcggctgccatcccgtttctgcctgacttaagggtgcccaaagggcaactaacaacaataatgctttgaaccaggtgctgcggggcattcacggacctcataatcaacttaattttctgtccagattcaacacgttaacgcaaatcatctgccagaatttaatcttgtgctgcacgagtcagcctatgtttatataaccatcagtccgtgactggtgcgcatcataaagtaagcggatagattgcgcaatttttatacagcactcatgactgattaaagcgaaacagcggtaacaggaaacgttgcgactgttcaacgatggcctccattgtctctggtgttaattgccgccagagcctttgataccagatatcatcaccttcgccacgcaccatcatgttgccttcgtaagcctgaaggaatttcgtacgggctttttgcaacgtggaatcgtcatccagcatggcatcgttttgcgcgtcataacaggtttttagccacgcgccgccactttcaggtaacaccagcaatggcgcggacattccttcacgatacccctcaatcagttgtgagaggtaatgcaaagcctgttcggctgcaagcggcggaaaacgccactcgccgtctttgcgtagaaaaaggcgactttcaccattaccaccgctggcacagtagacaaggtgttccagccaaagttgcattccctgggccacacttaataaagagggacgccagcgcaacaggccatccggctgcacctgcggcaaccagccagttatctgcacaccgttgcaggcgagatcaatttccatactctgccccggctggcgacaggcaatgactctgtcggcaagctgctgcatctcctggcactgtgtttcccagaaaatttcaccaaaagcgccatacggtaaatcccctgccgctcggaagcggcggaacaagcgttcggcatcatcctgctcaaccagtgcattcaataactgctgattgatttgataacggctaagtccttccagaataaatggctcggtgtcggggatttcgctgtcttcagtacggaagttcacctgcaaacgcatctggaaaaatgcccgcaccggatgtgcccagaatcgttgtagcgtttccagcggcacggtttccggtaaggtaaacggcagcggctgaacaaattcagaatgtgctttaccagcctggctggccgcaggtagccattcacgagcatagctttgtcgttcgcctggctggtagttttgtggatcaaacggcatccgggtatggaggcaagtaagatgcgcttttacccttgcctcgctttcatcacagttgagcgcttcatcgcccggtagataatgactttgcccgatgtagtcgatcagttcctgcaccagtaccgacgggaaacgctcactgttatcctgaatggaacgaccgatatagctgatatagagtttttgctgcgcggaaattaacgcttccaggaacagatagcggtcgtcatcgcgacggctacggtcgccacgcttcggtttctggctcatcaggtcaaagcccaatggcgcaagctgacgtggataaacgccgtcgttcattcccagcaggcaaaccactttgaacggaattgaacgcattggcatcagagtacaaatgttaaccggtccggcgagaaaacgctggctgatacgttcttgatccagacgctgtgccagttcatcacgcaatagtgacagcggcaccgcgtcgccatactgcgcacctaaaccttcggcgataatcgcctgccattgttgttcgatcagcgtcatcgccgcttcggtttccgcatccggcaggaagaaggcgttgagcatatcgcgacaaaccggcaaccactcttccagcggacgctcctgtgccagcccgcgacgccagatgtttagctgcattagcagtgaagccagatgccccaccagttctgcaattaagccgctcgattcatcataaggtagaaccgattgccactcgccctgcgcgctctccatcgcgtagcccaacaacatacgcgtcaggccaaatcgccaggtgtgttgtccggtggcggggagttccagctcgcgaacgttgtcgtcatctatgccccaacgaatgccggattcgttgacccactggcgtaaataacgcagcccttcttcggtgatgtcaaaccgcgccgccagcaccggcacatccagcaacgccagcacatcctctgacacaaaacgactgtcaggcagtgataacaggctgataaacgcttccagtaccggatgtgactgccgcgcacgacggtcggaaatggcgtaaggtaggtaacgatccgcaggtgcgctaccaaacacagcctgaataaacggactgtagctgtcgatatcagccaccatcacgatgatgtcgcgcggagtaagtgtcgggtcttcctccagcatcgccagcaggcgatcgtgtaaaacttcaacttcacgctgcgggctatggcaaacgtggaaggtgatactgctatccagtggatcaagcgggcgtttgttatcgctacgggaaaactcttcgatgttcacaccagcaacggcgcggttttccagttccagaatgtcagactgaatgttatgcagcaggttatctggcgtgacatcgacaaaggcgtccagctcctggctgctctccaggtcagaaaggagataaatgtagtcgcgcccaagcttaccccatgaagccagcagcgggttgccgacatcctgttcaccatcgctgttaaagagctgcccggcattttcgctatcacgaaatagcggcaattcgcgatcttcaaaactgtgtcgacgctgacgggtcagcagtttcgccagataagcaggatctttaatatcgccccagtaataacggcaggggttggtaaacaggagatggatttcaatatgtttacccagcgcctgtagcgcctggagataaacaggcggtaacgcggaaataccgcatataaagacgcgcgaaggtaaccccggcgggcaggtcgtcgcggactccagcgtttcgataaagcgctgatagagattggcgcggtgccagcgcggttgcccgagttgatgggtatattccaccagcgccttccacaacggggcttgccaggcctgtgcttctcccagcccttcaaccaaatgtcctgtttcccactgtgccagccagtccggacgatagaccagatactggtcaaacaggtccgccgcttttgaggaaagctggaacagttttcgcttgtcgctatcgtcagtcagataatgccgcaacagggtaaagtcttcgcgctccagcaattgcggcagcagagtcatcagtttccagctcatgctctgtttgttaaaggcgctctctttggggatttccggtaacacccggacgaacatatcccagataaagctcgctggcagcggaaaatcaatgtttgccgcaataccaaacttttgcgacagggtcatttgcagccactgtgccataccggtactttgcaccagaatcatctctggttcgaaaggatcgtccagccgttcgcgttcgacaataaactccatcaacgcttccagcacgtccagacgattggaatggtagacccttaacatagcggctcctgactactgacgattcgggcaatgcaggcgggtcatctcgccttctctgcccccgggtgaaactagcgtaacgctgatgctgacacatcccgcctgcgatgtctgcattcggttgacctgccagttggcaggtggcgaaatcgcgcgcagttgcgtttgctgccagccatgccgccagagctgttggtactggtttctgctggcaagactgttcattaatgttcgctggaaacccgataacgcagtgacaatcatcaccatcaacaccatcgccaacattacctccggcaggctaaagccttgttgattcttcagggaagctgacataacgccctctctttcagcggacaaaaatcgctccagccgcgtggcgaaaaaacaatgtttccatcaatgacttcgcctgttcgccacaacgaaacgccttcataaccggcaatcaataaggcttcattatctgccagtaaacgcaaacaaacctgggcatcggtttcagcgtactgcgagcactgaactgctggctgcgtctgccagcagtgcatttttccccacgccagcgccgactgaacgatggcctggcggcgcaatgactgactttccatgctcacgcgagaggcaaaactgcgatcctgttggctcattccttgtaatagcaaactacccaaaaccagcagcatcaggaccagagccagtgacgaaacacccttttcgcggttcacaggttgaatcctgtcacgctatagctggcattcaccacggtttgcggttcagacttactggcagcacgcatattaaccgtcaacaccggcgagaagccgctgacatcctgacgtacgacctgaaaagtgtcgataatgatggcatccggattagtgactttatcccagcccttaccttcacaggatgtcgcaccgcgtagcgtttccagcacatgctccttcagacgaaatccaatctggtcggactcttttaccggttcgcgatcccagataccgttactgttcgcatcccactgcacaatgacacagtcaccctgtccgacaatttccagcccttcgccggtacagatgccatgacaataacccgccctctggagatgcttcgcgacggtaaatacccgcagccagatttcatcttccagcgccagcttacgggtgctcgttaaactttcacgctgtaacgcaggcagaaagcgtgccgcccccagcaacaatacgctactgatcgccatagcaatcaacacttccagcagagaaaaaccttgctcttttacaggcatccttctgtttctccttgctgacaaagccggagtcttccccacggcgaaaccaccagccaccactcgcccgttgagtttttgaagcgaatatgcccggcccatgcggtattgcgcaggccaaagaaagcaagcgaaggtgtcaggtcgctcatttcgacttcgggccagcgtggcacaaagaccaatggtgaactgccatgacaggtattggccccagcagcggaactcacaaggcaccataacgtcccctccctgataacgctgatactgtggtcgcggttatgccagttggcatcttcacgtaaatagagcaaatagtcccgcgcctggctggcggtttgccatagccgttgcgactgctgccagtattgccagccatagagtccacttgcgcttagcatgaccaaaatcagcatcgcgaccagcgtttcaatcagcgtataaccacgttgtgttttcatgccggcagtatggagcgaggagaaaaaaagacgagggccagtttctatttcttcggcgcatcttccggactatttacgccgttgcaggacgttgcaaaatttcgggaaggcgtctcgaagaatttaacggagggtaaaaaaaccgacgcacactggcgtcggctctggcaggatgtttcgtaattagatagccaccggcgctttaatgcccggatgcggatcgtagccttcaatctcaaagtcttcgaaacggtagtcgaagatggattcgggtttacgtttgataatcaacttcggcagcggacgcggttcgcggcttaattgcagatgagtttgatccatatggttgctgtacagatgcgtgtcgccaccggtccagacaaaatcacccacttccagatcgcactgctgcgccatcatatgcaccaataacgcgtagctggcaatgttgaacggcaggccgaggaagacgtcacaggagcgctgataaagctggcaagagagtttgccgtctgccacatagaactggaagaatgcatggcacggtgccagcgccattttatccagttcgcctacgttccacgctgaaacaataatgcggcgcgaatccgggtcgtttttcagctggttcagtaccgtagtgatctggtcaatatgacgaccatctggcgttggccaggcgcgccactgtttaccatacactggcccgaggtcgccgttttcatcggcccattcgtcccagatggtgacattgttttcgtgtagataagcaatgttagtgtcgccctgcagaaaccacagcagttcatggatgatggaacgcaggtggcaacgtttagttgtcaccagcgggaatccatcttgcaggttaaaacgcatctgatgaccaaaaatggaaagcgttccggttccggtacggtcgtttttctgtgtgccttcgtcgagcactttttgcatcagttctaaatactgtttcatggttcctcaggaaacgtgttgctgtgggctgcgacgatatgcccagaccatcatgatcacacccgcgacaatcatcgggatggaaagaatttgccccatgctgatgtactgcacccaggcaccggtaaactgcgcgtcgggctggcggaaaaactcaacaatgatgcgaaacgcgccgtaaccaatcaggaacaaacctgagacagctcccattgggcgtggtttacgaatatacaggttgaggataataaacagcaccacaccttccagcagcagctcgtaaagctgtgatgggtggcgcggcagcacaccgtaagtgtcgaaaatggattgccactgcgggttggtttgcagcagcaaaatatcttctgtacgggagccagggaacagcatggcaaacgggaagttcgggtcaacgcggccccacaattcaccgttaataaagttgcccagacgcccggcaccaagaccaaacggaatgagtggtgcgataaaatcagagacctggaagaaggaacgtttagtacggcgggcgaagataatcatcaccacgataacgccaatcaggccgccgtggaaagacatgccgccgtcccagacacggaacagatacagcggatcggccataaactgcgggaaattgtagaacagaacataaccaatacgtcccccgaggaagacgccgaggaagcccgcatagagtaagttttcaacttcatttttggtccagccgctgcccggacgattcgcccgtcgtgttgccagccacattgcaaaaatgaaacccaccagatacatcaggccgtaccagtgaagcgccacgggtcctattgagaaaatgaccggatcaaactccggaaaatgcagatagctactggtcatctgtcaccacaagttcttgttatttcgctgaaagagaacagcgattgaaatgcgcgccgcaggtttcaggcgctccaaaggtgcgaataatagcacaaggggacctggctggttgccggataccgttaaaagatatgtatatgatccgcgctataaccctccgcgaatcagcccgcccatgccgcgacgctccataaaggctgcaacctgatggcgaacttcggtcgccagttgcgcttccagactacgctgcgcaagattttctgcttcggcataatcaatgcgccgcagcaggtattttgcccgcgctacagaacgtccgttcatagacagatggcgatacccaagcccaatgaggattgccacgcacatgggatcgcccgccatttcaccgcacaaacggagatcgattccatgtatttccgcttcccgggcgatcatcgccagagctcgtaacattgcaggatgaagactgtcataaatgttcgccacccgggtattgttgcgatcaacggccagaatgtattgagtcagatcgttggtgccaacagagatgaaatcgacccgctttgccagatgcggcagcataaataccattgacggcacttccagcatgatgccgatacgtggtttgggaatttcgtaaccgatcatctcctcgacttcacgtccggcacgttcaatcaggcggcgtgcttcatcaacttcatcgaggcttgtgaccatcggcaacagaatattcaggttgcccgtagcggcattagcacgcagcatcgcccgcacctggatcaagaagatctccggctgatcgagcgtaatgcgaatcccacgccaacccaggcatggattctcttcgctgatcggcatgtaaggcagctgcttatctgctccgacatccagcgtacgcaaggtgacgggtttatcattgaacatttgcagcatcccctgatactgcgccacctgttcttcttccgacgggaaaccactttgcagcatgaatgggatttcagtgcgataaagaccgatgccatcaatacggctgcccagtttttcttcatgttccgggcttaaaccagcattgagcatgacttttatacgctcaccgctttttaactgcgcgggtaaattgacgtcatcttccgccagacggctaagctcaatctcttcactaattagccgctgatattcttgcagcagtaccggctccggatcgaccagcaattcaccgcgatagccatcaacgatcagcgtcctacgatgcagcaccgaaggctgaatatccgcgcccatcacggtagggatccccagcgcacgtaccatgatcgcagcatgggagttggctgcgccatctcgcacgacaacaccgactaagcgatcctggggcagctcagcaagcgttgtcgctgacagttcatctgccaccagaatgaaacgttccggccaggcgttcggcccttgattagcgtcatcaagatgaaacagcaatcgctgacccagcgcacgtaaatcgccagcccgctctttgagatagttatcacttagcgcggcaaactgttcggcaaatttttcaatgaccgtttttaccgcccactctgccaccgagcctttatcaacctcggcaaacaattcgcgacgcagccgggtgtccgaaagcaggtgcgagtaaagatcgaaaatagccgccgtttctttttgtgcaccggcggcaaagcgtttgctgtagcggcgaaactcgtttgccgcttcttccagcgccccggtcagtcgttcgcgttccagagccggatccagcgttgatgcctgatacacctgttccattaaaggtaacgtggcatcctgccagccttcggcaatcgccacaccaggtgctgccggtaatgcgcggattcgcgtctggcgatattgcccaaacaaggcagtcaactgcgactgagaaagaatagctgccatctgggtggcaagcgtcaccaggaaggattcttcactttcgtcatactggcgcaactctcgttgctgtaccaccagtacaccaagcaactggcgacgttgaataattggtacgcctaaaaacgcgcggaaacgttcttcttttacggaggggatgtatttgaagctggggtgcttttgcgcatctgcaaggtttatcggttccgccagcctgccaaccaggccgacgatcccttcatcaaacgcgagcgttacagtgcgaccgcgtggttttttcagcccccgggtcgccatcaggtagtaacaacgtcgatcatgatcggccaggtagaccgaacagacctcggtatccatcgcaagacagatgtcggtaaccagaatatttaacgcctcattcaggcgtggtgcgctggctaccttttcgactatttcgcgcaggcgagtgagcataattggcgtgacttaacctcttttacgtcgataagcagatgcgttttgtggttttggcgtattttcctgcagtgacatcaccacactcgcgaactctttcattaccctacggtagacatcacgtttaaatgacaccacctgtctgaccggataccagtaacttacccatcgccagccgtcaaactctggtgtactgctggtttgcatattgatttctgcatcgccgctcaccagctgcaagagaaaccatttttgtttttggccgatacaaaccggcttcgtgtcccaacgcaccaaacgtttcggtaatttgtagcgcaaccagttacgcgttgaagcaaggattcgaacgtctttgcggcttaatcctacttcttcaaacaattcacggtacatcgcctgctctgcggattctccggggttgattccgccttgcggaaattgccaggagtgctgaccaaatcgccgggcccacattacctgcccctggcgattacaaatcacgatacctacgtttgggcggtagccatcgtcatcaatcaccggactacctcaaaataaagctttatatacgaatgattgtttcatactccaggaagacggtaaaccactctctgcagggcattacacactaataacaattgaataactcacagttatgtgcagagttataaacagaggaaggggtggatagccgtttttattcaccttttctgtggatagagttgtgaagaactacggaattactacgggaaaacccggagcattctgaataagcccgatatagacattttaaaatattcattatcagtcaatgcattacatgtaattttagtaatgaaaaagagtaattcgtgacccaggtcacacctctcatttacgggttggcgaaagatcaaccaatgccgtatttatccacagaatgtgccactaagttaagcactgaaccactaaaaactggagtttcgtcgcacgtcaaggctgtaaatggaaacagtagtggaggtttttcacagttatcccagctttctgtggataacatggtgtaagatcctgtttattttcagtgaccagatttggaaaacccgttgcagtgttgcgcaactcgattaccggcaacctaaaaagcaatataaatcagagaattgaacaacgcatgtggaaaaagttacactgcgaatattcggcacataattgctgtttgttttttaatcaaggtatcatgacatgtcccaacctcgcccactgctctctcctcccgaaactgaagaacagttgttagcgcaagcacagcaactttctggttatacattgggagaactggcggcacttgtcgggctggttacgccagagaatttaaaacgcgataaaggctggattggcgtgttactggagatctggctaggtgccagcgcagggagtaaacctgagcaagattttgctgctctgggcgtggaacttaaaactatccctgtggatagtcttggtcgtccgctggaaacaacattcgtttgtgttgccccgttaacgggcaatagcggggtgacctgggaaaccagccacgtgcgccacaaactcaaacgcgtactgtggataccggttgaaggcgagcgcagcatcccgctggcgcagcgtcgcgttggatcaccgttgctgtggagcccgaatgaagaggaagaccggcagctacgcgaagactgggaagaattaatggatatgattgttctcggtcaggttgagcggattaccgctcgtcacggggagtatttacagatacgaccgaaagcagcgaatgcgaaagcgcttaccgaagccattggtgcccggggcgaacggattctgacgctgccacgcggcttttatttgaagaagaatttcaccagtgcactactggcccgtcattttctgatccagtagccatcgctttgacctgccgctttccgggcatataattaccgcttcatttttttggcagggctttttagatgttatttgcatggataaccgatcctaacgcctggcttgcgctcggtacgctgacgctgctggagatcgttcttgggatcgacaatattattttcctttctctggtggtggcaaagcttcccacagcacaacgtgctcatgcgcgccgtctggggttggcgggagccatggttatgcgtctggcgctgctggcatcaatcgcctgggttacgcgcctgacaaatccgctttttacaatattcagtcaggaaatttctgcccgtgatttgattctgcttctgggtggcttgttccttatctggaaagccagcaaggaaatccacgaatccattgaaggtgaagaagaagggctgaaaacacgcgtttcatcattcctcggcgctatcgtgcagattatgctgctggatattatctttagcctcgactcggtgattacggctgtgggtctgtcagatcacctgtttattatgatggcagccgtggtgattgccgtaggcgtgatgatgttcgccgcgcgctcgattggtgattttgtcgaacgccatccttcggtaaaaatgctggcgctctctttcctgattctggtgggctttaccctgattctggaaagtttcgacatccacgtaccgaaaggttacatctacttcgcgatgttcttctctattgcggttgaaagcctcaacttgattcgcaacaaaaagaatccgctctgatactccgtacgctctcctgcgggagggcgtactcactccttttaccctcacagtttaagattttcctgctttcaagatatataacgtcggtttataaacagactattatcataggtaggccaaatgaggataaccggatgaaaaaatgggcagtaataatttctgcagtcggactggcgtttgctgtttccgggtgttccagtgattacgtcatggcgaccaaagatggccgtatgattttgaccgatggaaaacctgaaattgatgatgataccgggctggtgagttatcacgatcagcaaggtaacgcgatgcaaattaaccgtgatgatgtttcgcaaattattgaacgttaacaaataaggtcagcatccggctggccttaagatttttctctttcccttttcccttccctctgccatttttatattccttatgtcgtgattataaaaaggaaacggctatgcaatatcaccgtataccccacagttcgctggaagtcagcacgctggggcttggcacgatgacgtttggtgaacagaacagcgaagccgacgcccacgcacaactcgactatgccgtcgctcagggcattaaccttatcgacgttgccgaaatgtacccagtacctccgcgccccgaaacgcaagggttaaccgaaacctacgtcggcaactggctggcgaaacatggcagccgcgaaaagttaattatcgcctccaaagtgagcggaccgtcgcgcaataatgacaagggcatccgcccggatcaggcgctggatcggaagaatatccgcgaagcgctgcatgacagcctcaagcgcctacagactgattacctcgatctttatcaggtgcactggccgcagcgcccgaccaactgcttcggcaaactcggttatagctggacggattctgcgcctgcggtttcgctgctggatacgctggacgcactggcagagtaccaacgcgcgggaaaaattcgttatatcggcgtgtcgaacgaaactgcatttggcgtaatgcgctacctgcatctggcggacaaacacgatctgccgcgtattgtcaccattcagaacccttacagtctgttaaaccgcagttttgaagtaggtctggcagaagtcagccagtatgaaggggtcgaactgctggcctattcgtgcctgggtttcggcacgctgaccgggaaatatctcaatggtgcaaaacccgctggcgcacgtaatacgctctttagtcggttcacccgctatagcggtgagcaaacgcaaaaagccgtcgcggcgtatgttgatatcgccagacgtcatggcctggaccctgctcagatggcgctcgcgtttgtacgccgtcaaccgtttgttgccagcactctgctgggcgcaaccacgatggatcagctgaaaactaacatcgaaagtttgcatctggagttaagcgaagacgtattagctgaaattgaagcggtgcatcaggtttatacttatccggcaccataagattaacgccggttaaaaccggcgttaaatattaatgacggcgctgccagatccacagcgccgttattgccagcgcaaacagcgcaccgaagccaatgccaatgggcacgaccgggatgcctatcattaccgccagcgagtaaatgcccagcatcaacaacatggcgctgttttcgccaaggttttgtactgcaatcgcattccccgccccgacgctttttttaccccgctcctgtagcaacgcattgagcggaacgacaaaaaagccccccatcacgccaatcagcatcaacaaggcataggctggcagcagctcgtgttgcagggaaaaaatcagtaccaccacgccaatcaaaatcccggctggcatacagcgtgacacggtttccagcgtaactaacttcgctgccgcacctgcgccaaccacgataccaatcgctaccatcgcgttgagataggtgggcgtagcgttatcggtaatgcccagcgccaccggtacccacagcaccaacaggaaacgcagcgtgacacccgctccccagaataaactggtgcccaccagcgaaaaacgcgtttcaccattgcgccatagcgaggtgcaggcattcaggaaactgcgggtcatgttgatgagattccaggactgccccggacgcgccgccgccagtttgggaatgtagatattggcaacgaccgcaccaccgtaggccagtgcgcatgcggccagggcgacgaggacatgccagtcagccagcacaccaccggctacggaaccgagcaaaatcgccgctatggtagaagcttccattaaaccgttagctttcactaacttactacccgtggttaattcgccgagaataccgtatttcgccggtgaataggctgcagcaccaacacccaccagcgtatagccgagaaacggattgataccaaagcagatactggctgcgcccagcagcttcaggccgttggcaaacatcatcacccggcctttggcgaagctatccgccacctgcccgacaaacggcgcaaaaagaatgtaagcacctacaaacaccatttgcaggatgggctggctccactccggatagaactgcgctttcagtaacgccagagtggcaaacagtagggcattatcgccaaacgcagagagaaactgcgccacgataaccgctttcatccccttcgaccacaacgaagtgttagtgtgcactgactcactcatcgtgttgttccgcttcgtctacccagcttttcaacgtgacaaagtcaggtttgccgctgccaagtaatggcatctgtttcagatagcgaatatcgcgcggtacagcaagctccggcacgccgtgctcgcgggcatactgttgcaacttatcgcgcgtcagttcgttatctgtggtgaaaagcaccagtgcctcgcctttgctggcatcgctcttaatcgcagtggcatggactttatctggcgaaacaccaagtgccagttgttccaccatttccagcgacaccatttcgcctgcaattttggcaaagcgttttgcgcggccctgaatctgcacaaagccctgctcgtcaaaacgcacaatatcgccagtgtcataccagccgcgctccatttcgccgcgaacattctcggcggtgggcacttccagtacacctggcttctccacccgcagatagccgttcattatgttcggccctttcagttgcaggcgtccgccctcttcgataccagggaccgacaacaggcgcgcatccattcctggtagaatacgccctaccgtaccgggtttcgccgccatcggtacgttgatagaaacgacaggcgcgcattcggtcacgccgtagccttcaaggatgcgcaggccaaatttatcctgccaaagctgtttggtactttcttgtaatttttctgcgcctgccaccacatagcgtagacgatagaagtcatacgggttggcgaaacgcgcgtagtgaccgaggaaagtcgaggtgccgaacaacacggtgcaactgcggtcatacaccaactccggcacaatgcggtaatgcagcgggcttggataaaggaacacttctgcacctgtaagcagtggcgtaaacaggcctaccgtcagcccaaaggagtgaaacagcggtaacgccgacataaagcgatcgttggtggtgaagtcggcaatcgttttaatctgctcgacattcgccagaatgcttttatggctatggacgacgcctttcggatggccttcagaaccggaggtaaaaaggatcagcgcctcttcttccggctgctgtttaacctgtgccagacgcggcatcagcaaatgagcgaagatccatactttgtcggcagtggtgacatctgcttttaaatcttccagatagacccagcgcacctgagtaagttgctccggcagatgccagagtttgcctttatcgagaaactggcgggaagtgaagatggttttgatttcagccgccgtaatagcactggtcagcccttttaccccggcagtgtagttcatcattgcgggcatgcggcgacgggcgatggccccaaaaatcactgccgcactgatgcctgcattgggcagcattaagccgatgcgttcgccttcaacactgtatttttcaaggatgcgtccaacaaacagcgttttcgtaagcaatttgcgataggagtctggggtaaagttgacgtcttcgacacatttcttcccggctccgaagcggtacattgcactcagtaaagattcgtacagcgtttcacgcgggcgcaccgccattcgcgcttccatcattatttgatgcagcatttcgccagcgattttgcgacggtcacgggcacgcggcgcatccggcatcgccacctgcgttggtggcaaaatatgcagagtaatttgcgggaacaagcgacgtttaaccagacctttcaggcggctgaagtgcgtaagttccgccccttcaatacgcacaggaataaccgttgcaccagacttcgccgcgacaaaacccgcgccatcgtagattttcatcagcgagcctgtcgtggtgatgcgtccttcagggaaaatcaccactggtcggccctgttccaccagacgtaccagatgtttaatagccataggttgcgtcgggtcgagaggaacaaagtcgataaatgatttcagccaacgcatataccactgttggcttattgaggtgtaaacggcaaacactggacgcacaggtaaaaacagtccaagcaaaatgccatcaataaaagagacgtgattaggcgtaattagaacgcgctcgcccttcagtgcctgggtgtcacccgtaacgcgaacgcgatacaaaacacggcacaaatttcgaaaaaagctaaaaagcattccaactccctttgctctgattcagtaaaagcgaatggagggagattacacgagataaagaacgcgagcgacagtaaattaggtgcgaaaaaaaacctgcgcatccgcgcaggttggtgcaagagacagggtacgaagagcgtaccgaataatctcaccaatcaatacctctgggatcttgattgtggtctgcacgacgactcttcgccagcgagaaaacgcaaaggaatgaagggaaatgcaacgaggtgtgtaaattgtcggttactgttacagattgatgaccggcaaaaaaaacctgcgcatctgcgcaggctggtgtaattcatgtgctcaacccgaagttgacttcacctatcaatacctctgggatcaccactttagcaacctgaagccaaacgccaccagcggtcaatcgcaacagcgtttcgcaaagtgtaaccaaaggtttgcaatctctttttttgtcttacttatttgcgtttggctcacattcccacgatgaaaacacgccaccccttgaaccaacgggcgttttccgtaacactgaaagaatgtaagcgtttacccactaaggtattttcatggcgaccataaaggatgtagcccgactggcaggcgtttcagtcgccaccgtttcccgcgtcattaataattcacccaaagccagcgaagcttcccggctggctgtgcatagtgcaatggagtctcttagctatcacccgaacgccaacgcccgtgcgctggcgcagcagaccactgaaacggtcggtctggtcgttggtgatgtttccgatccgtttttcggtgcaatggtgaaagcggtcgaacaggtggcttatcacaccggtaattttttattgattggcaacggttaccacaacgaacaaaaagagcgtcaggccattgagcaactgatccgccatcgctgtgctgcgttggtcgtccatgccaaaatgatcccggatgctgatttagcctcattaatgaaacaaatgcccggtatggtgctgatcaaccgtatcctgcctggctttgaaaaccgttgtattgctctggacgatcgttacggtgcctggctggcaacgcgtcatttaattcagcaaggtcatacccgcattggttatctgtgctctaaccactctatttctgacgccgaagatcgtctgcaagggtattacgatgcccttgctgaaagtggtattgcggccaatgaccggctggtgacatttggcgaaccagacgaaagcggcggcgaacaggcaatgaccgagcttttgggacgaggaagaaatttcactgcggtagcctgttataacgattcaatggcggcgggtgcgatgggcgttctcaatgataatggtattgatgtaccgggtgagatttcgttaattggctttgatgatgtgctggtgtcacgctatgtgcgtccgcgcctgaccaccgtgcgttacccaatcgtgacgatggcgacccaggctgccgaactggctttggcgctggcggataatcgccctctcccggaaatcactaatgtctttagtccgacgctggtacgtcgtcattcagtgtcaactccgtcgctggaggcaagtcatcatgcaaccagcgactaaccgcagttaaagcaattccagcgccagtaattcttcgatggtctggcgacggcgaatcaaccgcgcctgaccattatcaaacagaacttctggtaacagcggacggctattgtagttggatgacattgatgcgccatatgcccctgtatcatgcagtaccagataatcacctgccttcacttccggcaaggcgcgggtttcaacatttcccccttcctgctgggtaaagacatcgcccgattcacataacggtccggcgacgacggtttccaccgttggcgcgtgttccagagaacgaccatcagctgccagggcactgatatggtggtaactaccgtacattgccgggcgcatcagatcgttgaacccggcatcaaccagcacaaagtggcggctccccatttgtttgacgctccgcacctgagtaattaatacgccagactgcgctaccaggaagcgacccggttcaatttccagtttcacagggtggcccaaatggcgggcgatttgctcacgcgcggcattccacagaccataataatgttcggtatcaaccgcctcttcaccctgttgataaggaacagaaagcccaccgcccgcagaaatagcctgtaaatcctgaccgaattcgatgacctgacgcaccatagcaccacacacctgttccagatgggcataatcaacgccagaaccaatgtgcatgtgaatgccgaccagctgcagatgatgacgttgtatcacgtccagtgcggcgggcagatcggtgtaccagataccgtgcttgctgttttcgccaccggtattggttttttggctatgtccgtgaccaaaccccggattaacgcgcagccatacccgatgccctggcgaaacctggcccagttggtcgagcatatcaacagaacccgcattcaccggaatttgcaattcactgacgcgttcaagcgtcgcctgatcgataacatctgccgtaaaaacaatatcatcggggtgcgtttgcggattgtaacccgccgccaacgcacgctctatttcgcctaacgagacggaatccactttcacgccctgctcacgcattaagcgcaaaatatgaatattggaacaggctttctgtgcaaagcgcaccacatcaaactgtttcagcgctgcaatctgccgacgaataatttgcgcatcgtagacccacaccgggcagccaaattcagcgggcaaacgcagcagattttcggcggtgagatcggtatcggtgctgaacagtgaatgtggcataacaaactccagataagtgcttttttatgattacgccacatcataaaaagaataaaaaatatcgatttatgtcgagtctatgcaaaaatgatatggattaccggattgcgagagagcgctaatggccgccgttaacttacgtcatattgaaatttttcatgcggtaatgaccgccggaagcctgactgaggcggcacacctgctacacacctcacagccaaccgtcagccgcgaacttgcgcgctttgagaaggtgatcgggctgaaattgtttgagcgcgtacgtgggcgattacatcctaccgtgcaaggactgcgtctgtttgaagaagtgcaacgatcctggtacggactggatcgcattgtcagcgccgcagaaagtctgcgcgagtttcgccagggagaactgtctattgcctgcctgccggtcttttcgcaatcttttttaccgcagctcctgcaaccctttctggcacgttatcccgatgtcagcttaaatatcgtgccccaggaatcaccgctacttgaagagtggctctcggcccagcgtcatgatttaggactcactgaaacgctccatacgcctgcgggaacagaacgtaccgaattactctctttagatgaagtgtgtgtgttacctccgggtcatccgctggcggtaaaaaaggtattaacgccggatgattttcagggtgagaactacatcagcctttcccgtactgacagctatcgccagttgctggatcagctatttactgaacatcaggttaaacgacgcatgatcgtagaaacccacagcgccgcgtcagtctgcgcaatggtacgggcgggggtaggtatttcggtggttaacccgctcaccgcactagattatgcggcaagcggtttagtggtgcggcggttcagtattgcggttccgttcaccgtcagcctgatccgccccctgcaccgcccgtcatcagcgctggttcaggcgtttagtgggcatttacaagcggggttaccgaaactggtcacttctcttgacgctattttgtcgtcagctacgacagcataaaagcgacagcatcctcggcatggatcgccgcggtatcaaacacaggcaaaacactgcgctcttctggcaccagtaaaccaatttctgtgcagccaaaaatgacgccctgtgcgccctgttctgcaaggcgagcaatcacttgcgcacaataagcgcgtgacgcttcggtaaattgccccagacacagttcttcaaaaataatctgattaattttcgcccgttcatccgcttcaggaataagacaattgatggaaaattgttccgtcagccgcccgcgataaaaatcctgttccatggtgtaacgcgtacccagcagcgccacacgagtcattccggccccggtaattgcacgtccggtggcatccgcaatgtgtaagaaaggcagagtgcaacgtgactcaatggcatccgccactttatgcatcgtattggtacatagcacaataccttctgcgcccgcccgctgtaagccaagcgccgcctcagccagaatgtccccggttttatcccattccccgcgacgctggcactcttctatttcatgaaaatcgacgctatgtagcagcacttgcgcagagtgaagcccaccaagccgctgtttaatgccttcatttatcaaacgatagtaaggaatggtggattcccagctcattcctcccagcaaaccaattgttttcattcctctctcctgatgtgtgttaccgcaacaaggctgaataaggaacgagacaaacgcctcaacggccaagtgcccaatctctattaacgaaaaaagggccggatgtacagcacatccggcccgtgaaatcagacgccgatatttctcaacttctcgcctgccatcagtttgcgttcgatatgttccagcgtgacatttttggtttccggaatgagccagaaagtaatgcccacaaacgcaatgttcagcgcagtgtagagccagaacgtaccggcagcgccaatgctatcaagcagtgtcaggaaggtcgcgccgataatcatattcgacacccagttcgtggtggtcgaacaggtaataccgaaatcgcggcatttcagcggctgaatttcagagcacaggatccacaccactggcgcggcgctcatcgcataaccggcaatacacatcatcgtcatgccaacagagagccaggacaagccactggaagccgtaccgttatcaaactgcatcaggcaatagcccagcaccagagtgcctaacgccatcacgctgaaaccaattttcagagccggtttacgccctgctttatctaccgtaaacaccgcaataaaggtggcgaacataaaggtcagccctacgaccagagtcgcaatcatctgttgttctgtggtcgtaaagcccgccattttgaagatacgcggcgcgtagtacatgatgatgttcataccggtaaactgctgcatcgcctgcaacaacataccgagaaacacagcacgacggacgttacggttgatcttaaacagtgcccaaccgccctgttttaacttcaggctttcacgaatttcgttgagttcttctcgcgctttttccgacgtatcgcgcagcatacgcaatacttcttccgcctcaatatgacgccccttttccgccagccagcgcgggctatttggcaggaagactaccagaataatcagcagaactgctggtaaagcaagaacccccaacattgcgcgccagttaccgctataactgaacgctgtatcggataaaaacgccagcacgatgccgagtgtgaccatcaactggtacatactgatcatcttaccgcgaacgttttcacttgccatttcagaaagatacagaggagcggtgtaagacgcgatcccgacagcaatgcccagcaccacacgagcggcgattaacatctctacgctggtcgcaaaagcggaccctatagaaccgagtacaaacaggatggcccccgccatcaggctgtatttacgccccaggcggaacgacagccaaccattaaacagcgcaccaattgctgcaccgagcatcatgctactaaccacccattcctgcaaacgactggtcagcacaaagtgatcggtaatgaacggcaacgctccggcgattacgccgatatcaagaccaaataacaatcctgcgaccgcagcagctaccgaaacaaacatattcatacgccgcgtatcccgcaaagaacgtggcgttaaagcagattccgtattgatagtaaccattttttcctgccagcagagagtaagacatagtgaaaaaatacgtgaacaactcacgcaggtgtcaggtcggaaacagcataaatatggattaaattgctgcgacatgtcgttatgtgatggatattccaattttcaaattaagttgaattattgagattattattaaccacctaattttacagcagataaaattcataaagttcattaattgataattaatatggattatttcataaccatgatatggattatgatgatctacaggtataaaaaaccctgccatgcggcagggtcataaaagtaagaagaatgaattaacgcgccagccaaccgccatccacggcaatggtataaccattcacataatctgaagcgctggaggcaaggaacactatcggccccatcaggtcactcggcagtccccaacgaccagctggaatgcggtcgagaatttccgcgctacgttgttcatctgcccgtagttgttgagtattgttggtcgccatgtaacccggggctatcgcattaacattaatgttgtgtttagcccattcgttcgccatcaatcgcgtcacacccatcacgccgctttttgatgcggtataagaaggcacacggatcccgccctggaaggagagcattgacgcgatattgataatcttgccgccattgccttgcgcgataaagtgtttcgccgctgcctgagacatgaagaatacgctcttgatattcaggttcatgacatcgtcccagtccttttcgctgaactcgagagcatcttcgcggcgaatcaatccggcgttattcaccaggatatcaatatgaccaaactccgctaccgcgcgatccagcagtgctggaataccatcaatctttcgcagatcggcggtcaggcttaaaaaacgacgccccagcgctgtgacctgctcgatggtttcagtcggttcaacgatgttaatgccaacaatgtcacagcccgcttgcgccagccccaacgccatcccctgacccagtccagtatcacaaccagtgacgaccgcaactttaccttcgagagaaaatgcacttaaaatcataacaataccttattcgtttatgcccacaactagcgcaaatctttaacggccacatggtccatatcatcaaagacctggttttcaccgaccatgccccagataaaggtataagctttggttccgacaccggaatggatcgaccagctcggggagatcaccgcctgctcgttatgcatcacaatatgacgcgtttcttgcggctgccccatcatgtggaaaacgcaggcgtcatcatccatattgaaatagaaataaacttccatccggcgctcgtgggtgtgacacggcatggtgttccacaagttacccggagccagctccgtcagccccatactcaattggcaggtttccagtacatccgggacaaaatatttgttaatcgtgcgacggttactggtgaggttatcgcctaacgtgactggagatacttcgtccggtgtgacttttttggtgggatacgtcgtatgcgcgggtgcgcaattgtaataaaacttcgccggagtgccggtatcaatactggcaaagacaacttcttttgcacctttaccaacatacagggcgtcgcggtgaccgatttcatagcattggccatcgacagtaatcgtaccggcaccgccaatattgataacacctaactcgcgacgttcaaggaaatagcttacgccgagttgtttaccaacttccccgccaacggaaaccgttttagttatcggcataatgccgccaacaataattcggtcaatgtggctgtaaaccatggtgtactcatcggcgacaaataccttttcaaccaaaaattcattgcgcagcccttgggtatccagcgtttttgcgtgcgcactgtggatgctctgtcttacgtccacatcaacctccgataatcagtgaagcgtgaaaatagaaaacgatagtgaaacactgtttcgttttctctataaagggatgatatgcccatgggctagggttttcaattaaaaataaaacaatgtttcatttttaagttaaggattaaaaaaagtgcagtgtcgatcacgaatatgtcatgagaatggaaaaatgagggagcccagaaaatgtatgtcgacttgccagccatcattattcaacagattaatgacggcagatatttatcggtaaggaggaaatgcagagctattcgtcacgttcaatggtcaatgccacaccctggcccccgccgatacaaagcgttgccagtcctttgcgggcattacgtttcaccatttcatgaaccagagaaaccaggattcggcaaccggaagcgcctatcgggtgaccgagtgcgatcgcgccaccattgacattgacccgacgctcatcccactcaagcatcttgccaaccgaaagcgcctgtgcagcaaacgcttcattagcctcgataagatcgacttcagccaactgccagcctacacgctccaggcaacggcgggtcgcatacaccggcgcaattcccatcaatgccggatctacaccaacgctggcaaatgcgcgaatgcgggccagcacgggtaaattcaacgctcgtgctttggcttcgctcatcatcattaccgcagctgcgccatcgtttatggatgatgcattacccgctgtcacagaaccgagactatcaaatgaaggatttaaacgggctaagccttctgcgctggcgtcagtgcgtggctgttcatcggtatcaacaaccaacgtctgcccgttactttgggtcattaccgggacgatctcatctttaaatcgtccggcgtcaatcgccgctcgcgctttttgttgcgagctaagtgcgtaagcatcctgcaactgacggctgatgccatattcgcgagccagattttcggcggtgacaccaatatgataatcattgaaggcatcccacaacccatcatgcacaagactgtcaaccaactggctattgccaagctgtgcaccggtgcggctatcagtcagaacatgtggtgcgcggctcatgttttcctggccaccggcgatgacaatatcagcctcgccacactgtatcgcctgagtagccagatgcagtgctttaagcccggaaccgcaaacgtcattaatagtgattgcagaaacgctattaggcagaccacctttaatagccgattgccttgccggattctgccctgcccctgcagtcaacacctgaccaagaattacttcatccaccgcatatgcaggaacgccggtacgttctattaacgctttcacgaccagactaccaagttccacggcggaatgacccgctaacgcaccacgaaagcagccgataggtgtccgtaacgccccgacaatcacaacgtctttcatcacaacctcgcaccaattaacagtgcaatagtaaatgattgttaattacagttatcttaattgtttaaaaaaagtgatttttatcacaaaggaaatatgcctgagcagcagtcagagacataactggcacgtaaggtttgcaaccactaacccaccaatagaggggtagatagggcgttaatctcccatacttaacctggtttatggtaaattgccctccattttgtttaatttgtagatgatacgttcagataatgtctaatatttggtctaaagaagaaactctgtggagtttcgcgctctacggcacagccgttggtgcaggcacgctcttccttcctattcagttaggttcggcaggggctgtggtcctgtttattactgctctggtcgcctggcctttaacatattggccacataaagccttgtgccagttcatcctctcatcaaaaacatcagcaggtgaagggataacgggcgcggtaacacactactatggcaagaagattggtaatctgattaccacgctgtacttcatcgccttttttgtcgtcgtgttgatatatgcagtggcaattaccaactcacttacggaacagctggcaaagcatatggttattgatcttcgcatccgtatgttggtgagtctgggtgttgtattaattctgaatctcatttttctgatgggacgtcatgccactattcgggtaatgggatttttggtattcccattgattgcctatttcttatttctttccatttaccttgtcggtagttggcaacctgatctattaacaacccaggtagagttcaatcagaatacccttcaccagatatggatatcgattcccgtgatggttttcgcctttagccatacgcccattatttctacgtttgccatagacagacgtgaaaaatatggcgaacacgctatggataaatgcaaaaaaattatgaaagtcgcttatctcatcatctgcataagtgtactgttctttgtctttagctgcctgctttctattccaccttcgtatattgaagctgctaaagaagaaggggtcaccattttatcggcgctttctatgctgccgaacgccccagcatggttgtcaatttccgggattattgtcgcagtagttgcgatgtcgaaatcattcctgggtacgtactttggcgttattgaaggtgccacagaggtcgtcaaaacaacactacagcaggttggtgtaaagaaaagtcgtgcatttaaccgcgcactatcaattatgttggtatcgctgattaccttcattgtttgttgcattaacccgaacgcgatttcgatgatttacgcgatcagcggcccgctcattgccatgatacttttcatcatgcctacgctgtcaacgtatctcatcccggcgcttaaaccctggcgttccatcggaaatctgattacgctgatcgtgggtatcctgtgcgtatcggtaatgttctttagctaatatcagttgtggatggttcaaaattgctacaattttgaaccattccatttttcataatattcatttgttattattccaccctatcacttctctcgtcatatcctagtattatcagttagttaaacacacaaagagatctgaacatcttaaataagactatttaagatgcataacttagattcgcaagatatcttctggtcattcaaaaacaatttgcgatatagatattcttataccatgagatagttatctggaccgctctcaaccatgcaagattaaatcagtgaaacataatcatatttgataacgagaaatgcatttttaaatgccttactcagaattatagcaaatacagattaatcgcaatttttcccggcaaaattacaaaatcatggtgtattgacatcatcaataaccaatgaaattatgcaattatatacggatagggaggttcttaacatggggctttgtagtcgttataaaagtcttacatgcaatagttgctcaatgcattgccaaataatgccagaagagtcaccgcgtttgcagtattgcgcaaactcgtgtttttgtatgtggcccgaagaaagttcatattttaatcgtggtgtggtagaaggtatcttaacaaaaaaccacaatgcgagattaagcggatatatttttgtcgatttttcagtaagttttttacgtctattccttgaaaaagactggattgactatcttgcaagtactgacatggggattgttttagtcagcgaccgcaatatgcaatcgttagctaattactggcgaaaacacaactcagcaatatctgctgtcatatataatgatgatggtcttgatgttgccaatgaaaagatcagacaactatttattggtcgttatttatcatttaccggaggtaacacattaactcagatggaattcaccataatggggtatatggtttctggttataatccatatcagattgctgaagttctggatatggatatccgtagcatctacgcgtacaagcaacgaatcgaaaagagaatgggtggtaaaataaacgaattatttattcgttcacattcggtccaacattgatactcaacgaccagccagaatcatactctgtttatacgggcatttattgaaatgtccgtattttataaataggccgtcccctcaagagtaaacaccatagtatttaaaaccatcacacgaaaaattcagaagcattacgaaatatgaatttacaaacaatagtggcataaatgttaaccatgttaatttacgtaaagttttacgttgcaacattaaagcctcatttcaatcatcatgataaatataaaattaatatatatttatgccgtaaataccaatatacttagcaaactatgtgatctccatttcgattgatttagtgtttattgacgtatgtactggattattaacgataatatcgagttctggcctgagcaccgaaaattaatatcggtacataacgccgatcttaacgtcgttctgacaacgccagccagtcgatgtttatcacttctacttgaagcttttcctgatgtggttgcacaacaagattttttcaccagagtctgggaagaagaaggtatgcgtgtgcctactaacacgttatatcagaacatatccattatcagacgcggatttcgcgctgttggtgatactacccactcgctaattgcaaccgtgccgagaagaggattcaagatccataatgacattaacatacaaaatcatgtaataaactcgtcaacagacgcacatacacacaatgccccacctgccataaaagttaatgcgggatacaaagagagcattggtggcgcaaagaatttcaataacaaaatcctcaaacatataaaaagtcatctaattatgttgagcgcatttgtcataggcgcatattctgcatattggctatggaataataatcaaccgaagccatttttcaaggattacaagactgttgcggaaattaatggctgccattttaatgtaacagaagatacaattgatgggttgaaagagttcgataaatataaaacacggatactggattcggggattaactgtaaaaaacatccgtggttatacttccctcttgcaaaatcctcaccggggatgattgttatggcatgcaataaaaactataaccaacatgaagtggcaaactgtttaaccctgtcttaccgtgaggttaatcgtgattgattataaaaaaaacttattatttattttagtttttatcagtgggtttattctcttcactgtctattcttacactgcagaaaaaatgatatataacgaaacatgcactgcaaattgggtaatttttaatgaccagggacgagcaaatcttaccatcgactttatgtataacaaaaaaaataaaacaggaactgttgcgttgagtggaacctggcaacaaggtaacagagaaagtaaatcaatacggcgaaatattgaatacacatggattgaaaactatgacacagcccatttaacatcaaagaaagttaataagtttgagattatggatcaagttgatgatgatagacttgcacaacttattcctgatttttatgtctttccagaaaaaagtgtaagctataatatactaaagcaaggtaagcatgcttttattttgagcattggtaacagagcaataatgcattgtgcaaggtaaactaaaatagataacaaaaagatggaacctcgttaatcataaaacaataaaattaaatattctcgcagtatatggcagtctaaagcatcaaagatttgatcaacatctttcattttagacatctccttgcaatgtaaaatatcatgtatcaacaacatctggtgcaaatccatgagtcgaactcgacattcatcttagctcgattattattccttcgtacagtcgatgtaaacaatacagaaagaggattattaagaaccagtttactcagtgaatcaatagaggaaaggactaacgtttctttaaaagaattgatttcatcatctgttaaactaaactcatcattgacagatcgtgagatataactgtttttaactttactctttacgttgactttattgacagaattaacattcacatatcttgaatttaatgtccatgatgttgtttgcgtgagaacattctcagcattaaggaatttttttaacggaatccttggtttctttttcgagtccgaatttacaatatcatgcatatagaccatttcatgaatctgcgaaaattcaatgtccattgtatacctcacatttttaccgtgactcgatgttactgttcaataatcaccttccatcaatactaaaattaatacccctaatgtgccgataacaaatatagtcattctacgtaacgtctccataaggtgatatttgacattatcagaagctgcgaattcggattttgctctaatcaaatgagagaaatgtaaaatgaagccacgaaatattaataatagcctaccactgcaaccattagttcctgatcaggagaacaaaaataagaaaaatgaagagaaatccgttaatccagttaaaatcacaatggggtctggtttaaattatattgaacaagaatctcttggaggaaaatatctaacacatgatttgtcaataaagatagcggatatttctgaagagataattcagcaagcaatattatctgctatgagcatatataaattttcgataacagatgatttaatgagtatggctgtaaatgaactcataaaactgaccaaaatagagaataatgtagacctgaataaattcactactatatgcacagacgttctatccccccgcgtcaccagacataataaagaaaaaaacaaacgacattctacccttctcaaaaatcccctttttaattttcattgaaaaaatggcaattgatactatgaatccaggtcatacacattaaggcatttatgtaatgtcgtaattaagataactaataaggtgaatattagtaaaacaactaatgatgttattagtttgtagtgaacagtacttttaccaataatgaaaaatataccataagcaatgcaagcttaaaactcataatttaaaaaagataaatataaaaatatcaatgagtcaatcaataataatttggcatcacgagacacatcacagaggaatattatgagcacagaaacaattgaaatattcaataatagtgatgaatgggcaaatcaactaaaacacgcattatcgaaaggagaaaatctggcattactacatggtttaactcctgatatccttgatagaatatatgcatatgcattcgactaccatgaaaagggtaatataacggacgcagaaatttattataaattcttgtgcatttatgcgttcgaaaatcatgagtatctaaaagattttgcatcagtatgtcagcccaaaaagaaatatcaacaagcatatgacctttacaaactaagttacaattacttcccgtatgatgactattcagttatttatcgtatgggtcaatgtcagattggggctaaaaatatcgataacgcaatgcaatgtttctatcacattattaacaattgtgaggatgatagtgttaagagtaaagcgcaggcatatattgaactcttaaacgataattcagaagataatggctaagcattacaatcatttggttaaatttgctggttatagtgcagttaaccactataaccagcacctcttatgttttcttaaatcagcatcttaaaacagttaagagcatactataaatcattatttttcaatgcgttagagaacaatctactttatcaaaattgaataaggctatttcagattacatcactgaattcctaagataaattagtgaacacaaccatagatatgtcaaatgtaatttcctgtagcgttaatgacacataaatatgaatagccataatttctattgcttaagcaggatgcaagaaaccaattttttcatagaggttaactaatggacttagaaaataaattctcatatcattttcttgagggattaacgctcacggaagatggaattcttactcaaggaaatgagcaagtttatattccacagaaagagttaggtgtattaatagtattacttgaatccgctggtcatgttgtactgaaagatatgatcatcgaatcagtatggaaaaatattattgttagtgacgagtccctgacaagatgtatctattctttgcgctgcatttttgaaaaaattggctatgatcgttgcatagaaacaatctaccggaaaggttatcgtttcagcgggcaggttttcaaaactaaaattaatgaagataatacttcagactattccatagctatattccctttcactacttcattgaatacactggatccattaatacttaatcaggaattagtgcaaatcatttcaaataaaaaaatcgatggtctctatacctatccgatggctgcgacaaatttttgtaatgatcacatatctcaaaattcattcttgagcagattcaagccagattatttcgttacaggaagaataaaccagaataatgcagtgaacactttatacattgagttgatcgacgctaaaaaccttttcctcatcgccagtaatcatctccctgttgatgaactacataatacatcacaatttattatagataatatccttcaaacggtacataaaccagaacgatctgtaagattagctaagcaggaccaaggatataagaatcattatttatcagatgaaatgttagccggaaagaaagaactttacgacttcacccctgaaagcatttacagggccatgactatatttgatagattacaaaataaaagtgatatacagacgctaaaaacagaatgttattgccttctagcggaatgccatatgtctttggcacttcatggaaaaagtgaacttgaacttgctgctcaaaaagcattagagcttttagattatgtatcagacataaccactgtcgatggaaaaattttagctattatgggactgataactggtctgtctggacaagcaaaagtatctcatatcttatttgaacaggctaagatacactcaactgatatagcctctctctactactatagggcactagtccactttcataatgaaaaaattgaagaggcaaggatttgtatagacaaatcactacaactcgaacccagaagacgaaaagcagttgtgataaaagaatgtgtagatatgtatgtgcctaacccgctcaaaaacaacattaaactctactataaagaaactgagagtgaaagccatcgagttataattgacaacattttgaaattaaagcagctgacgagaatttgtatgcgataaatttttattgacgcaattttattatttagatgtatgcaacttgttatttaaacaacagagataaaaatatctaagatattcaccttattgcaagatatttaaaatgctctagagttaaaagtatgatgtaaagaccattggcctggacaattaaaaaagggagctttatgactaatccaatcggtatcaataatttatctcaaagttcaaatatagcgaatgcaacgggtgatgaagtcgtatcattagataaacacatcaacaccagtgctactgatacagatcaaatacaagcatttatagtttcaacatggatggcgccttttcaaaatgatatgtattcagaagataatcctatctcaccttactataaaattgagtggtagacgattgaccaaataaatcataacgagatacttttataatagtatctcgttcctttcattcaatcctcacacatgaaaaaatatgcgctcaccaaaagttaaattcttaaccatcttcacgttttgtatatttattacaaaaatgtctttcgccagcaactcttgctctaatgaagcaggaacaatgttcagaatcgaaccaaatttaattaaagctatcgctcttgttgaaagcaatctaaaaaaggatagcataggcaagaacagagataagaataacaatataaagagtttagattattggttaatgcagataaaccagatgcatattcccctgttaaaaaaacgtggaataataaaagatgaacgagatttgttagataacccttgtctgaacattaaaataggaaccgagattttatataaccatttttcacgttgtggagtaacgtggcaatgcctggggacttataatgcgggttttgcaatggataaccaaaaaaagagacagcaatatgccccaaaatatatattgtatataccaggcttaatgaactagacaatcgtaaggcttcagcaaaatgagcctaaagcctcttttttttatatagtgcaaacacccatacgtaaagctgttttgatcaactcgataccactgtgaacatctaatttcttcatgatattgagtctatgagtttcgactgttttcctgcttaactgcaagaaattagcgatttctttgtttgttttaccatcagctatgagttgtaatatttctgactcacgatttgtaagttgattatcagaggaatacctggaagatattttttcacaatccatatgtacactatcaaaataagtgtaaccattactaatcgaatcaatagcacgatttagtttcgccgggtgactggttttccatacgcatcctttcgcacctgcttcaagcaattttattgaatcaatatacggcatctttgctacaaatgtaataatatgagcatctatcttatgcgatttaacccattttacgagttcggcccccatcattccacctgcaaattctcctaaaataaatatttaggctgtagatttgttacactccgctatagctttcttcagatctttatagcccccaacaacctcatataaatcaggataatgtccgagaaatccaattatcccatcaatcataaacggctgctgatctgaaactacaattttaatttttcccatatattcatcctgagtgtaaatgctttaacgcattcatttataatcatcccttccattattattataagcaaaatccaaagaatacattgatgaaataataatgaaatataattaaaaataaaatttttgcgtaaaaaaataccacaggcattaaaaaatcatgagatgattaaaatattacaattagattatattcaaatcattaaacttgagccagggagctataagtcctcagggcttgccaaaacagaattattcatatccaaagaatgtgtttcaaacattttttcaactaaataatgtctggcttgttcgcagatttcgttaaccttgtcaggggagaaacaatgattattaattaaatattgctcacaattatccacaaattcctgcggactaaattcagcaataaattgatcggtaaaaaacacaaaacgcttatcatcatgaaatgtaatatggacattccatattgatttgtcgacaaaatatgactctacttcaagagacttatctttgaaactggtaggtatatggagatttacaggacctgatattgatggtaattttgttacccaactttcaaaaattttgataaaaacatcaacttcttctgaaggttttaacaatatactcttcagatcgtttatcatgtttattcttttttttcaagttctgagcatagcaagcttatcaagggtataaaattatccatctcatcaataatgccttttgtatagccatcataataaccttgaataaatttttcttctctcttttcctcaatactctgaatttttgcggtggtttcaagaaggattttttctttaagagaaactatttctttcaatccatcagaaatttttcttttaatcacaacaccatttgcaggagattttatcaagctcatctctattttttttcgcataaaatgtaattctctctaaaagtgttgatgcaagtggtaacggcgattgtatgtggtcaacaaaatcaggaaataataaattaaatcgttgctgcattgccaatggttgttgccttatatagggtaacaacgttgaaaaaccacatgtgatgatattgtgatagttagcgatgccgggtttgtatcgtgccttttcatttatttccagcggtatagctgataaataatcccttagtacatcaggaaccttataaaaaaacccgcgttctgcaaacctttctcgataaaagtgacaaccactgagtaaacagatcaatggaagtaaattccaattgtttattggatttgcccctatatttccagacatctgttatcacttaacccattacaagcccgctgccgcagatattcccgtggcgagcgataacccagcgcactatgcggatgccattcgttataatgctcgaacgcctctgcaaggttctttgctgccgttaacccgtctggtttgggcatgatactgatgtagtcacgctttatcgttttcacgaagctctctgctattccgttactctccggactccgcaccgccgtgttcttcggttcaagtcccaacatccgggcgaactggcgtgtttcattagcccggtagcatgaaccattatccgtcagccactccactggagacgacggaagatcgttgccgaagcggcgttccaccgctcccagcatgacgtcctgtactgtttcactgttgaagccgccggtagtgaccgcccagtgcagtgcctcacgatcacagcagtccagcgcgaacgtgacacgcagtctctctccgttatcacagcagaactcgaacccgtcagagcaccatcgctgattgctttctttcacggccactctgcctgtatgtgcccgtttcgatggcggtacagcaggttttcgctcaagcaacagcgcattctggcgcatgatccggtaaacacgtttggcattgatcgcaggcataccatcaagttctgcctgtctgcgaagcagcgcccatacccgacgataaccatacgttggcagctctccgataacatggtgtatacggagaagcacatccgtatcatcagtgtgacgactgcggcggccatccatccagtcatcggttcgtctgagaatgacgtgcaactgcgcacgcgacacccggagacaacggctgactaagcttactccccatccccgggcaataagggcgcgtgcgctatccacttttttgcccgtccatattcaacggcttctttgaggagttcattttccatcgttttcttgccgagcaggcgctggagttctttaatctgcttcatggcggcagcaagttcagaggcaggaacaacctgttctccggcggcgacagcagtaagacttccttcctggtattgcttacgccagagaaataactggctggctgctacaccatgttgccgggcaacgagggagaccgtcatccccggttcaaagctctgctgaacaattgcgatcttttcctgtgtggtacgccgtctgcgtttctccggccctaagacatcaatcatctgttctccaatgactagtctaaaaactagtattaagactatcacttatttaagtgatattggttgtctggagattcagggggccagtctaaacttgctcttttcttctggtgtttatctttgaaagatttgtaggataaataacattaagtaaagccgcatcggcttctctgtaatgtttatctttttccagataacctggggattctccccctaaatcaagctgtaacgttattctttcataacctttatctatgaggtggttcaacctcgttgttgaaagagtttcatccagttcattgactttagcttcgcgtagtaaatcagagacaaaaacagagtctttcttcgagagtaggtttgacaaacgttccagtccagaggtcaccagtgcaacggaagatgtgtttaatcgggcatcttcttcccatgctcaggaatcttccataacatagaaattggctttatccagataagcaatcagcagcgcaaccgactttaatcggtcacctttttgccaatcttcagcgttaatagtaccagtgttgattgcttgtataaggagatcaaggtaaagacctaaagcatcattttgtttatggttccacagctgcggcttgccttcttcctgcacatctgccatcacgggggagttgctgtcaaatcggatatgcacagcattcatttgcacgggaattccatccagtcgttttgggttgctaatgacgtcctgcatccgcttaatctggtcgggcgtagacatataatcccacagggtgagcagaaccttttttgcggctacactatttccctgatctgatactaatgccatatagccccataaactatccctcaaccagacagcatcatagtgggtttctgccgctgttttgtcatcttcgaaagtagaagcaagaataaacgttccccagggtttctccgtcaacgttaactttcgtgtgttttctgttaatgttagcaatccttgaatttcgtctttggtatagtggctctttatttcattttgtaatttggctgagtgaatcagaagacgataattaggatacttatctggatttaacgataaataacttttatctgttgctgcccccgtggaattaagaatgttaaatacagattcactcgtcacttctgcccctgtcgcctggcatgtgccgcacgaaaatataccagcgagcagaagagttaatgcagatttccctttcataaaatattccatcaatcgtttgttaaaagcgtagataaccacttatttaacaacttgaaaataaggtgttttacctgggttgttacaaaaggattgcattgcgtaaacgctttttatttacaacaaaatggggaagtattacggcgaagataaattggagcgggcgaagggaatcgaaccctcgtatagagcttgggaagctctcgttctaccattgaactacgcccgcttcgagatgcgtaaggcattataaaccttacgctctccttagcaagtgccacgctgctgactgctgattaattcgccatcagcattttggcttgctgccctgaggcggcaagtaacgtagcggatcaattgccgttgcacggtaacgaatctggaaatgcaggcgaacagatgccgcatccgtgctccccatagtggcgattttttgcccagccttcacgctttgcccattatttaccagcatcgtgtcattatgggcgtaagccgtaatgtaatcttcactgtgtttaatcatgatgagattaccgtagccacgcagctggttgcccacatacaccacctttcctgcacccgcggcgtaaataggtgtaccccgtggagctgagatatcaatccctttattgccgccatctgctgtcgaatacggcatgataactttccctgtcgttggccataaccaacaacgttgccctactggcggccaggatgatttcggtaccgctgatgacggtgtaaccgatgcggttttggtcgttgatttggcggttgatttacgtgtaatactgctacttttcgccccacccagttttagtttctgaccaacttcaatggtgtaagggggggaaatgccgttcagtcgcgccagttcttttacgctggttcccgtggtgcgcgaaatacgatatagcgtatccccccgtttcacggtgtaaacggagccggaatacgttcctgtatcggatgatttgctacccgaacagcccgccaaaagcagtccaaccgataacaacatcacgatacccagagattttttattcaggcgtcccgcactcaaaatctttcctcgcttaaaaaacaagacgccttatcatagcagccagcctcttgatacccaatctcttgcttctggaaaaacgtggtaatagagaaagaggttaatttcatttggcaaagggaagtatcatcagcaaaatattcgctgtagaggtatcgaacttcctgactttttaccctatttcccatcctgatgcgtaataatcccaatttatcacattgattttatcgccactcatattgatacgtatcactgcccctattcagagtcctgtttcgtatcatatctgtgtttttttaacgtcatcacacttcctacctcccctaacgcttatcgtcgtttctggcgtaaatcttgcctgcttagactaaatctttgccataagaaccaaatgttcaaatcgaggggatttctatggaagcgcgggaagcaaccgctacgggtgaatcatgcatgcgcgtcgatgccattgctaaggtcaccgggcgggcacgatatactgacgattatgttatggcgggcatgtgttatgcgaaatatgtacgtagccctatcgcacatggttatgccgtaagtattaatgatgaacaagccagaagtttgccgggcgtactggcgatttttacctgggaagatgtgcctgatattccattcgctacagctgggcatgcctggacacttgacgaaaacaagcgcgataccgccgatcgcgcactgctaactcgccatgttcgtcatcatggtgacgccgttgccatcgtcgtggcccgcgatgaactcacggcagaaaaagcggcgcaattggtcagcattgagtggcaagaattacccgttatcaccacgccagaagcggcgctggcagaagacgctgcaccaatccataacggtggcaatttactgaaacaaagcacgatgtcgacgggtaatgtccaacaaacaatcgatgccgccgactaccaggtacaggggcactatcagacccccgttattcaacattgtcacatggaaagcgtaacatcgctggcgtggatggaggatgactcgcgaattaccatcgtttccagcacccagatcccgcacattgttcgccgcgtggttggtcaggcgctggatattccctggtcatgcgtacgagtcatcaaaccatttgtcggtggcggttttggtaataaacaggatgtactggaagagccaatggcggcattcctgaccagcaagcttggcggcattccggtgaaagtttcccttagccgtgaagagtgtttcctcgcaacccgtacccgccacgcttttaccattgacgggcaaatgggcgtgaaccgcgacggaacattgaaaggttatagtctggatgttctgtctaacaccggcgcttatgcatctcacgggcactccatcgcttctgcgggggggaataaagtcgcttacctttatcctcgttgtgcctacgcttacagttcaaagacctgctataccaacctcccctcggctggtgcgatgcgtggttatggcgcgccacaagtcgtatttgccgttgagtctatgcttgatgacgccgcgacagcgttaggtattgatcctgttgaaattcgtttacgcaacgccgcccgcgaaggagatgctaatccgctcacgggcaaacgtatttacagcgcagggttgccggagtgtcttgaaaaaggccggaaaatctttgaatgggaaaaacgccgtgcagaatgccagaaccagcaaggcaatttgcgccgcggcgttggcgtcgcctgttttagctacacctctaacacctggcctgtcggcgtagaaatagcaggcgcgcgccttctgatgaatcaggatggaaccatcaacgtgcaaagcggcgcgacggaaatcggtcagggtgccgacaccgtcttctcgcaaatggtggcagaaaccgtgggggttccggtcagcgacgttcgcgttatttcaactcaagataccgacgttacgccgttcgatcccggcgcatttgcctcacgccagagctatgttgccgcgcctgcgctgcgcagtgcggcactattattaaaagagaaaatcatcgctcacgccgcagtcatgctacatcagtcagcgatgaatctgaccctgataaaaggccatatcgtgctggttgaacgaccggaagagccgttaatgtcgttaaaagatttggcgatggacgctttctaccaccctgaacgcggcgggcagctctctgctgaaagctccatcaaaaccaccactaacccaccggcgtttggctgtacctttgttgatctgacggtcgatattgcgctgtgcaaagtcaccatcaaccgcatcctcaacgttcatgattcagggcatattcttaatccactgctggcagaaggtcaggtacacggcggaatgggaatgggcattggctgggcgctatttgaagagatgatcatcgatgctaaaagcggcgtggtccgtaaccccaatctgctggattacaaaatgccgaccatgccggatctgccacaactggaaagcgcgttcgtcgaaatcaatgagccgcaatccgcatacggacataagtcactgggtgagccaccaataattcctgttgccgctgctattcgtaacgcggtgaagatggctaccggtgttgcaatcaatacactgccgctgacgccaaaacggttatatgaagagttccatctggcaggattgatttgaggataacatcatgtttgattttgcttcttaccatcgcgcagcaacccttgccgatgccatcaacctgctggctgacaacccgcaggccaaactgctcgccggtggcactgacgtactgattcagctccaccatcacaatgaccgttatcgccatattgttgatattcataatctggcggagctgcggggaattacgctggcggaagatggctcgctacgtatcggctctgcaacgacatttacccagctaatagaagatcctataactcaacgtcatctcccggcgttatgtgctgcggccacgtccattgctggaccgcagatccgtaacgtcgctacctacggtggaaatatttgcaacggtgccaccagcgcagattctgccacgccaacgctaatttatgacgcgaaactggagatccactccccgcgcggtgttcgtttcgtcccgattaatggctttcacaccgggccgggcaaagtgtctcttgagcatgacgaaatcctcgtcgcctttcattttccgccacagccgaaagaacacgcgggcagcgcgcattttaaatatgccatgcgcgacgcaatggatatttcaacgattggctgcgccgcacattgccgactggataacggcaatttcagcgaattacgcctggcatttggtgttgccgcgccaacgccgattcgctgccaacatgccgaacagactgcacaaaatgcgccattaaacctgcaaacgctggaagctatcagcgaatctgtcctgcaagatgtcgccccgcgttcttcatggcgggccagtaaagagtttcgtctgcatctcatccagacgatgaccaaaaaagtgattagcgaagccgtcgccgcggcggggggaaaattgcaatgaatcacagcgaaacaattaccatcgaatgcaccattaacgggatgccttttcagcttcacgccgcaccaggcacgccgctctcggaattactccgcgaacaaggactgctaagtgtcaaacaagggtgctgcgtgggtgaatgtggtgcctgtacggtgttggtcgacggcacagcaatagacagttgcttataccttgccgcctgggctgaaggaaaagagatccgcacgctggaaggtgaagcgaaaggcggaaaactttctcatgttcagcaggcttatgcgaaatccggcgcagtgcagtgcgggttttgtacgcctggcctgattatggctaccacggcaatgctggcgaaaccacgcgagaagccattaaccattacggaaattcgtcgcggactggcgggaaatctttgtcgctgcacggggtatcagatgattgtaaatacagttctggattgcgagaaaacgaagtaaaaggatatccggcctgaattcaggccggattcactgaggttatgtgtttaacaactcatatttcttaatcttgcgatagagcgtagcaatgccgatgcccagttcatcagcaacttgcttcttgctgttatgacgtgaaagcgcctcgcggatcatttgcttttccatctcctccagcgccgtgccgcccgcatcatcgagtgacaggtgcgcctcactgacctctgttacatcactttgctccgttgtgccattattcagcagatttggcggcaatagcgtgctgtcgataacttcacctgaaggaaccacgttaaccagatattccatcaaattgcttaactcgcgcaggtttccgggccaacgatgcttacgcaatatttcgacgacatcgggagcaatgccaggataaaccgatcccagacgacgggtatgcagatgtaaaaagtaatgcaccaatagttcaatatcttcctgacgttcacgcagcggtggcagagttatcgggataacattaagtcggtagaagagatcttcgcggaatttaccttcggcaatgaactgggccaaattctgattagttgcagaaatgatgcgaatgtcgacttgtattgggctactggcaccaatcggcagaatttcacgtgcctcaatagcgcgcagtaatttagcctgcaacattaatggcatatcacctatttcatcgagaaacagcgtgcccgtattcgccgcctgaatcaaccctgttttaccgttggcagaagcgccagtaaatgcacctttaacataaccgaacagttcgctctccagaagctgctccggaatcgcggcacagttgatagcaataaagggtttattccgtcttccgctcaacttatggattgcacgggcgacgacttctttacccgtgccgctttcaccaaccaccataacgctggatgggctgggtgcaatacggctaatgagtcgttttaattgccgcataacacggcactcgccaaccaattgttcaatatgcggttcatcaggtgcatttgctacagaaaaactggtatgcgattggtgaaacgccattaaaaataattgtcggccctgaatgttatgcaattgaccaatgattaattcacttttatcgtcccatgaaacaatatgctgcatatgtccatgggtaaaattactctcaaatgttaatggtctgaaacggataggtttcccaataatattattttgcacaacaccaagtgtttttaaggcagtctgattaacaaactgaacccgattttcatcatctacaactaatacgccctgatccatattatcgatcatggtcgcaaatattttactgatgttatctcctggcccctgatcctccagaagtttcgaaacaaaaatggtggatatatggcgaacataatcagaaaattcgcgtaaattatcactgatatgctcttgttgctcgtgggtaacggcaatcaaacttatcaccccaacacaacgatcctgtaaaatgacaggcgtacccagaaatgctttttcgcggcaattttctttactatcgcaaccttcgcaaaggggatcgaagcgagactgtgtcacaactttttcagttttcgtttccaggacgtggcggagcaggcgtgagttgccgctcaactggcgaccaagaaacttcccatacgcgcccgttccggcaacgcgacacaagttttcatcaacgatctcaacctcaagctgcaaaacgctggcaagcattctggcaaaacgctgaattgtcggttgaatttgcatcaatactgactgcgtagtagcaagctccatagctttaccttccagacttacttaaaagtcgatcattgaagacgttgatggttcacagatcatgatgatattaactcaggcgaaattggctttgataaaaacataagatttttatcattttctaatgaaattatggaagagatatcacatttctatatcaatatgagaattacggcggtgagtttatcaaactgaagagagatagcctgcccctttatcttatttctgatacttagcagcaaataaataacgcgataaaaaaagccaaacgttttcgtattttacaaacaaccagaagctggcatcaatttgtgatcaaccccacacattatccgtcaaattagtcttttgcagccgcgcggataattctggcacacttattgttagtcccaggtatagctgtgaaaacaccaatcactttggcaagtcacagtgaaataaaccactttgcctgtcattccactaccgggactttatgatgaaaactgttaatgagctgattaaggatatcaattcgctgacctctcaccttcacgagaaagattttttgttaacgtgggaacagacgccagatgaactgaaacaagtactggacgttgccgcagcattaaaagcactgcgtgctgaaaacatctcaaccaaagtctttaatagtggattaggtatttccgtattccgcgacaactccacccgtacccgcttctcttatgcttccgcgcttaacctgctcggccttgcacaacaagatctcgacgaaggcaaatcacaaatcgctcacggcgaaaccgtgcgtgaaaccgccaatatgatctccttctgcgccgacgctattggtattcgcgacgatatgtatctgggcgcaggcaacgcctatatgcgtgaagttggcgctgcacttgatgacggttacaagcagggtgtactgccacagcgtccggctttagtgaacctgcaatgcgatattgaccacccgactcagtcaatggctgacctcgcgtggttacgtgaacactttggttcactggaaaacctgaaaggtaaaaaaatcgccatgacctgggcctactctccaagctatggcaaaccgctctctgtaccacaaggcatcatcggtctgatgactcgcttcggtatggatgtcaccctggcccatccggaaggctacgacctgatcccggatgtggttgaagtggcgaaaaacaatgctaaagcctccggtggtagcttccgtcaggtcaccagcatggaagaagccttcaaagacgcagacatcgtttatccgaagtcatgggcaccttacaaagtgatggaagagcgtactgaattgctgcgtgcgaacgatcacgaaggcttaaaagcactggaaaaacagtgtctggcacagaacgcgcaacacaaagactggcattgtactgaagagatgatggaactgacccgtgatggcgaagccctgtacatgcactgcctgccagctgatatcagcggcgtatcctgtaaagaaggtgaagtgactgaaggcgtattcgaaaaataccgtatcgctacctacaaagaagccagctggaagccttatatcatcgccgcgatgatcctgtcccgtaaatacgccaaaccaggtgcactgctcgagcaactgctgaaagaagcgcaagaacgcgtgaaataacccctcgggccgatcagctggtcggccctctatttccagaggccaaaaggataggatatgtccgttttctcattgaagattgatatcgccgataacaaatttttcaacggcgaaacatcaccgctcttttcgcaaagccaggccaaactggcgcgccagttccaccagaaaatagctggttatcgcccaacaccgctttgtgcgctggacgatctcgcaaacctttttggtgtgaagaaaattctcgtcaaagacgaatcaaaacgattcggtctgaacgccttcaaaatgcttggcggtgcgtacgccatcgctcaattattgtgtgaaaaatatcatcttgatatcgaaacgctgtcatttgagcacctgaaaaatgccatcggcgaaaaaatgactttcgcgaccaccaccgacggcaaccacgggcgcggtgtggcgtgggcagcacagcaactcggacagaatgcggtgatttacatgccgaaaggttctgctcaggaacgcgttgacgccattctgaacctcggtgccgagtgcatcgtcacggatatgaactatgacgataccgttcgcctgaccatgcaacacgcgcagcagcacggctgggaagtggtacaggacacggcatgggaaggttacaccaaaatcccaacctggatcatgcaaggctacgcaaccctggcagatgaagccgtcgagcaaatgcgtgaaatgggcgtaaccccgacgcacgttctgctgcaagccggtgtcggagcaatggccggtggtgtgctgggttatctggtcgacgtctatagcccgcaaaatctgcacagcattattgttgaacctgacaaagctgactgtatttatcgctccggcgtcaaaggcgacatcgtcaacgttggcggtgatatggccaccatcatggcaggcctggcctgtggcgaacctaacccgctgggctgggaaatcctacgtaactgcgccacccaattcatctcctgccaggacagcgttgccgcattaggtatgcgcgtgctgggtaatccgtacggcaacgacccgcgcatcatctccggtgaatccggcgctgtcggtttgggcgttctcgcagcggttcattatcacccgcaacgtcaaagcctgatggaaaaactggcgctgaacaaagatgccgtggtgctggttatcagcactgaaggcgacaccgacgtgaagcactaccgcgaagttgtctgggaaggcaaacacgctgtagcaccttaatcaccctattggaactgctccctgcaaaacggggagtaaaaaatctggagaaaaataatggctaagaatattccattcaaactgattcttgaaaaagcaaaagattaccaggcggatatgactcgcttcctgcgcgacatggttgctattcccagtgaaagctgcgacgagaaacgcgtagtacatcgtattaaagaagagatggaaaaagtcggcttcgataaagttgaaatcgacccgatgggcaacgttctcggttatatcggccacggcccgcgtctggtggcaatggacgctcatatcgataccgtcggcattggcaacatcaaaaactgggacttcgatccgtacgaaggcatggaaactgatgaactgattggtggtcgcggtacttccgaccaggaaggtggcatggcctctatggtttatgccggtaaaatcattaaagacctcggtctggaagatgaatataccctgctggttaccggtacggtgcaggaagaagactgcgacggtctgtgctggcagtacattattgaacaatccggcattcgcccggaatttgtggtcagtaccgaaccaaccgactgccaggtataccgtggtcagcgcggtcgtatggaaattcgtattgatgttcagggtgttagctgccacggttctgcaccagaacgcggtgataacgccattttcaaaatgggtccgattcttggcgaattacaagaactctcccaacgtctgggttatgacgaattcctcggcaaaggcaccctcaccgtttctgaaatcttcttcacatccccaagccgttgcgctgtagcagacagctgcgcagtttcaatcgaccgtcgtctgacctggggcgaaacctgggaaggcgcgctggacgaaatccgcgccctgcctgcagtacagaaagctaacgcggttgtttctatgtacaactacgaccgtccgtcctggactggcctggtttacccaaccgaatgctacttcccgacctggaaagtggaagaagatcacttcaccgttaaagcactggtgaatgcctacgaagggctgtttggcaaagcgccggttgttgataagtggaccttctcaactaacggcgtatctatcatgggccgtcacggcattccggtgatcggctttggcccgggtaaagaacctgaagcgcatgcacctaacgaaaaaacctggaaatctcacctggtgacctgtgccgcgatgtacgctgcaatcccgttaagctggctggcaacagagtaattactcttcacttattcccctccggttcgccggagggtttttggagtttgctatgcgcgtattgatcaaaaacggcactgtcgttaacgcagatggacaagccaaacaggatttgctgattgaaagcgggattgttcgccagttgggcaacaatatttcgccgcagctcccgtatgaagaaattgatgccactggctgttacgttttccctggcggcgtggatgtccatacgcatttcaatattgatgtcggcatcgcgcgcagttgtgatgatttttttaccggtacccgcgcagctgcgtgtggcggtacaacaaccattattgaccatatgggatttggcccaaacggctgtcggttacgccatcaactggaggtttatcgtggttatgccgcccataaagcggtcatcgattacagctttcacggtgtgatccagcacattaatcacgcaatcctcgacgaaatcccgatgatagtcgaggaaggactgagcagttttaaactctatttaacctatcaatacaaactcaacgatgacgaggttttgcaggcattacgccgcttgcatgaatccggcgcgctgaccaccgtgcacccggaaaatgatgcggctatcgccagcaagcgggcggaatttatcgccgcagggttaaccgcgccgcgctatcatgccttgagtcgccctctggaatgcgaagcggaagccatcgcccgcatgattaacctggcacaaattgccggtaacgccccgctctatatcgtgcacctgtctaacggcttaggtctggattatctgcgtcttgcccgtgcgaatcaccagccagtctgggttgaaacctgcccacaatatctcctgttggacgaacgcagttacgatacagaagatggcatgaagttcattcttagcccaccgctgcgtaacgtacgcgagcaggacaaactgtggtgtggcatcagcgatggtgcgattgacgtggtggcaaccgatcactgcaccttctcgatggctcaacgcctgcaaatttctaaaggcgatttcagtcgctgcccaaatggcttacccggtgtggaaaaccgcatgcagttactgttttccagtggcgtgatgacgggacgtataacaccggaacgctttgttgaattaaccagcgcaatgcccgccaggttgtttggcctgtggccgcaaaaaggattattagcgcccggttccgacggcgacgtggtgattatcgacccacgtcagagccaacaaattcagcatcgccatctccacgacaacgccgactactcgccatgggagggttttacctgtcagggcgcgattgtcagaaccttatcccgtggtgaaacgattttctgtgacggcacctttacaggcaaagccgggcgaggtcgtttcctgcgacgcaaaccgtttgtccctcccgtgctctaaccactgccagggatctatacacaatcaagaatgatgagtgaggaaaaatgagtaagaaaattgttctcgccctgggcgggaatgcgctgggcgatgacctggccgggcaaatgaaagcggtaaaaattacttctcaggcaattgttgatttaattgcccagggacatgaagttatcgtcactcatggtaacgggccgcaggtgggcatgattaaccaggcctttgaagctgccgcaaaaactgaagcgcactcgccaatgctgccgatgtctgtctgtgttgcattaagccagggttatattggttacgatctacaaaacgctttaagagaagaactgctttctcggggcattaataaacctgtagcaacgctggttactcaggtcgaagtcgacgctaacgatccggcattcctcaacccgaccaagccgatcggttcgttctttaccgagcaagaagcagagcaactgacaaaacagggttacactctgaaagaagatgctggtcgcggctatcgccgtgttgttgcctcgccaaaaccggttgatatcattgaaaaagaaacggttaaagctctggtagatgcaggtcaggtggtgatcaccgttggcggtggtggtatccctgttattcgtgaaggtaaccatctgcgtggtgccagcgcggttatcgataaagactgggccagcgcccgtttagcagaaatgattgatgccgatatgctgatcattctgactgcggtagaaaaagtggccattaacttcggtaaagagaatgaacagtggctcgatcgcctgtcattaagtgatgctgaacgctttatcgaagaaggtcattttgcgaaaggttctatgctgcctaaagtggaagctgccgcctcgtttgctcgctctcgcgcaggtcgtgaagcactgattaccgtattgagcaaagcgaaagaagggattgaaggcaaaacaggaacggtgatttgtcagtaatttaaaggccgggtgggtaataccatccggccaaagattgtcaagtaagtgcgctttgttgatgccggatgcggcgcgagcgccttatccgtcctacaaaacatcgcaaattcaatagattgcaatgcacttgtaggcctgataagcgtagcgcatcaggcaatttggcgtttgtcatcagtctcaggccgggtgggtaataccatccggccattttcatttaagccacttccagcacttcttttgtcgctttcacgccctgatgcatcaacatcattaacgcctcaagtacgccgccgccaatcgcccgggctttatcagaaacgctggtgaaatcagcggtttcaccacgaggatcgatatcaccaattttaaaaccaccaaccactgccaggccgtcgttcaacaagccacgcaccatccccgtcaacggtgctttaatttcatgctcaccaatccaggcaatcacatcgccctctttcaccagatcgcctaatttcacgttggatcgcataatgcctgcagcaggagcacggatcacccgtcgggtggtatgccccataatattgccaggaacaccggtattctcctgcgcacaaccagagtaaatcacctgaccgagccagtgcccgcgatttgtttcaattaccgcatgacaatccttcccagcagtaaagcccggcccaagcgcgattgttactggtgccatatctgcccgcgttcccaaattctgtttcgccagaatagcgtccaccacgcaaagcggtttcagttcatcaagcaatgaacaggcgggatctaccatcacaggaatgaatccgcgttcggtaagtttcatcgcttccgcagagctggttgccaggcgagcagtgacgccttcgaccgtcatttcgccatcgaacacggcctgggcaaacgccacggtacaacgaatcactgtcggtttttccacttccagcatgatcactttaaaacccgcatgatacagacgtagcgccacaccactggcgatatctcccgcaccgcgaatcaccaccagctggtgtccggaaggatgagaaggtttcatcatcagcccacccggcgcgttatttttcacctgtaatatttctgccagcacgctgatggcgatctcctgcggcgtttccgcacctatgttgtaaccaacgggcgcatgtaaacgggcaatatgttcttcagccacgcctttctcacgcaattgacgcaggaaaagctgaaccttgcgacgacttgccagcaaccccaaccatgcaatgggctgttcaatgagtttgtcgagggcttcacgatcctgattattcgtggcaatcaggacaaaattatcagggcgaatatccagtgcttccactgccgcaccaaacgactcagcatggagaagcgtggttgatggtgggaatagttcaggattgaggctttcgcgataaatatcagcaacggcaatatcaaatcctaatagcgccgcactctgggctatcgcccggttgacatgccccgcgccaatcaacaccagacgtggacgcataccatggacgctgataaatactgacattgcacctccacaatctgacccgacagcatccgcaccgttacgagccatacgtccatggaataatcgcggcttacgttcctgcaatgcctgaagcgactcttcaatcaccttccgctcaaccattccgccaccaattgtaccgacgatagaaccatcggcgcgcactaacatttgtgcagaatggcggggagtcgagcctcggctatcaacaatttgcgccatagcaaacggacaattttgctcttcgagttttgcagcctctgtgaaaatattcataccaacctcaatggatatcctttcagtaacccggaatacccgggccgctaattcacaaatctgcgcgcgattgcaggatgttcttgtatatcgcccagccagattgcctctacgtcgtgttgttgcagcggttgaaggagctcgctttgtgcaatcgcattctcacattgagaaaaacggttaatgaaccagactcgccgacaaccttgcggtacgtttttaaacgccccctgagggtggcgaaccagcgcaacgagatcgctcagttgcaaggttgcatcaggtgttaacccggtaatatcagcaaactgcgaccagcgatggacattttctgtgctcactttcgcgcccaaagtatgtcctcccatcacagcaatcacgcagcaactgcttttgggtatgcaaggttcgtgctcatcaggcgcttttaacggcattccacgcgagccatctgcttcaatgagaattacgtcacactctggtcgttgcaccagtgcatcaatcgcttctggcgtaaatccctgcacttttccctggttcgctttccagctgtgaaaacaaaatgaaatgggggatgtaagagacgcatgaggaagcatggcgggatcacgacagaaaaccacgggccagtgagacgttggcataaacatatgtgtcgtcgtcgtgattaacacacgcctgccgctagcctggagcagttctgccagccaaaaaagcaagctggttttccccccagcaccaacaacagaaatcacagtgggacgtttctgcgcacctaaatcaatgactaatgccgatgggtcaactatacttttcacgagtctttatgacctctctgggataaattatccccaacttaatccatcaggaagtaacgcaattatcaggcgttattagcccctataaataatggaaccactatgtcagccatcgactgtataattaccgctgccggattatcatcaagaatggggcaatggaaaatgatgttaccctgggaacagggaacaattcttgatacaagtatcaaaaatgcgttgcagttttgtagccgaattattttagtcaccggctatcgtggtaatgaactgcacgaacgttatgcgaaccagagcaatatcactattattcacaacccagattatgcgcagggtttactaacatccgtcaaggccgcagtacccgcagtgcaaacagaacattgttttctcacccacggtgacatgccaaccctcaccatcgatatttttagaaaaatctggtcgttacgaaatgatggcgcaatactgccactccataatggcatccccggccatccgattttagtgtcaaaaccatgcctgatgcaggcaatccaacgacccaatgtcaccaatatgcgtcaggcactccttatgggagatcattattccgtcgaaatagaaaatgcagaaataattttagatattgatactccggacgactttattacagcgaaggaaaggtatactgaaatttagaaaacgtagttaaacgattgcgttcaaatatttaatccttccggcactcattatcataatgataaggaatcactgattttgagaaaagagaaaaattgataaatgggctggcaataataattttcaggagtgattttaattctcatttagcacctgtgagttcattcacaaaaagcccttaagtttcgagccgcctcacatttttttatatttcccgccaaacctggcaagagtggtgcgattgttgctctatccccctaaaccaccggatttctcaacaccggtcactcaatgatatctgtataagctaaggagagggttatgggggatattatgcgtcccattccgtttgaggaacttttgacgcgcatatttgatgaataccaacaacaacgctcaatctttggtattcccgagcaacagttttactcacctgtaaaaggtaaaactgttagcgtcttcggtgaaacctgtgccactcccgtcggccctgccgctggcccgcacacgcagctcgcgcaaaatattgtcacttcctggctgactggcggacgcttcatcgaactaaaaaccgtccaaattcttgaccgcctggagctggaaaagccctgtatcgatgccgaagacgagtgctttaacaccgaatggtctaccgagtttaccctgcttaaagcctgggatgaatacctcaaagcctggtttgccctgcaccttctcgaagcgatgttccagccttctgattccggtaaatcgttcatctttaatatgagcgtcggttacaacctcgaaggtattaagcaaccgccgatgcaacagttcatcgacaatatgatggacgcatctgaccatccgaaattcgctcaatatcgcgatacgctgaataaattactccaggatgacgcatttttagctcgccacggattgcaggaaaaacgcgaaagcttgcaagccttacccgctcgcatccccaccagtatggtgcatggcgtcaccctctccaccatgcacggctgtcctccgcatgaaatcgaagccatttgccgctacatgctggaagaaaaagggctcaacacctttgtgaaacttaacccgaccttactggggtacgcgcgtgttcgtgagatcctcgatgtctgcggtttcggttacataggcttaaaagaagagtcatttgatcacgacctcaagctgacgcaagcactggaaatgctggaacgcctgatggcactggcaaaagaaaaatcactcggctttggcgtaaaactgactaacactctcggcaccatcaacaataaaggcgcactgcctggtgaagagatgtatatgtcaggccgtgcgctgttcccgctctccatcaatgttgcagcagttctctctcgcgcctttgacggcaaactgcccatttcttattccggtggtgccagtcagctgactatccgcgatatttttgatacaggtattcgccctattactatggcaaccgacctgctgaaacctggcggctatctgcgcttaagtgcctgcatgcgcgagctggaaggctccgacgcctggggacttgaccatgttgacgtcgaacgactgaacagactggcagcagatgcgttaaccatggaatacacccagaaacactggaagccagaagagcgtattgaagtggcagaagacctgccgctgaccgactgctacgttgccccctgtgttactgcctgcgctatcaagcaagatattccggaatacatccgtctgcttggcgaacaccgctatgccgacgcgctggaactcatctaccaacgcaacgctctgcccgccattaccggtcatatttgcgatcaccagtgccaatacaactgtacccgcctggattacgacagtgcgctgaatatccgcgaactgaaaaaagtcgcgctggaaaaaggttgggatgaatataagcaacgctggcacaaaccagccggttctggttcacgccatccggttgccgtgattggtgcaggtccggcgggtctggcagcaggttacttccttgccagagcgggccatccggttacgctgtttgaacgcgaagccaatgcgggcggcgtggtgaaaaatatcattcctcagttccgtattcctgcagagttaattcagcacgatatcgattttgttgccgctcacggcgtgaaatttgagtatggctgctcacccgatttaaccattgagcagttaaaaaatcagggcttccactatgttctgattgccaccggcactgataaaaatagcggtgtgaaactggcgggcgacaaccaaaatgtctggaaatcactccccttcctgcgtgaatacaacaagggtacagcgctcaagctgggcaaacatgtggtcgttgtcggggcgggtaacaccgcaatggactgcgctcgtgcggcgttacgcgttccaggcgtagaaaaagcaacgatcgtttaccgtcgttcactacaagagatgcccgcatggcgcgaagagtatgaagaagcgttgcacgacggcgtagagttccgtttcctgaataatccggaacgtttcgatgctgatggcaccttaaccttgcgcgttatgtcgcttggcgaaccggatgagaaaggtcgtcgtcgtccggttgaaaccaatgaaacagtaacactgcttgtagacagcctgatcaccgccattggtgaacagcaggatactgaagccctgaatgcgatgggcgtgccgctggacaaaaacggctggccagacgtcgaccataatggcgaaactcgtctgactgacgtctttatgatcggcgacgtacagcgcggaccatcctccattgtcgctgctgtcggaaccgcgcgtcgggcgaccgatgccatccttagtcgggaaaatatccgttcccaccagaacgataaatactggaacaacgtcaatccagcggaaatctatcaacgtaaaggcgatatctctatcacgctggtgaacagtgacgatcgtgacgcgtttgtcgcccaggaagccgctcgctgcctcgaatgtaactacgtttgcagcaagtgtgtggatgtctgcccgaaccgcgccaacgtctccattgcggtcccaggcttccagaaccgtttccagacgctgcacctcgacgcttactgtaacgaatgcggcaactgcgctcagttctgtccgtggaacggtaaaccgtacaaagacaaaatcaccgtcttcagcctggcgcaagactttgataacagcagcaacccaggcttccttgtggaagattgccgggtacgagtacgtctgaataaccaaagctgggtgttaaacatcgacagcaaaggtcagtttaacaacgtaccaccggagctgaacgatatgtgccgcatcatcagccatgtccaccagcatcatcattatctgctgggccgcgtggaggtgtaatcatgttgattctgaagaatgtcactgcggtacagctacacccggcaaaagtgcaggaaggcgttgatatcgccatcgaaaacgatgtgattgtcgctatcggcgatgccctgacgcaacgctaccccgacgccagcttcaaagagatgcatggccggattgtgatgccagggattgtctgctcgcacaaccatttttactcggggctttcccgcggaattatggcaaacatcgccccttgcccggatttcatctcaacgctgaaaaatctctggtggcggctcgatcgcgcccttgatgaagagtcgctctattacagcggactgatttgttccctggaagcgattaagagcggatgtacatcggttatcgatcaccatgcctctccggcgtatatcggcgggtcgctctccacattgcgcgacgcatttttaaaagttggcctgcgcgcgatgacctgttttgaaactactgaccgtaacaacggcatcaaagagttgcaggaaggtgtagaagaaaacatccgtttcgcccgtttgattgatgaggcgaagaaagcgacaagcgagccgtatctggtggaagcacatatcggtgctcacgcgccgtttaccgtgccggatgccggtctggagatgctgcgtgaagccgtgaaagccacaggccgtggtttgcatattcacgctgcggaagacctttacgacgtttcctacagtcaccactggtacggcaaagacctgctggcacgactggcgcaattcgatctcatcgacagcaaaacgctggtcgctcatgggctgtacttgtcgaaagatgacatcaccctactcaatcagcgcgatgcgttcctggtgcataacgcccgttcaaacatgaacaaccatgtcggctacaaccatcaccttagcgacatccgcaatctggcgttgggaacggacggcattggttcggacatgtttgaagagatgaaatttgccttctttaaacatcgcgatgcgggtggtccgctgtggcctgacagttttgccaaagccctgactaacggtaacgaactgatgagccgcaactttggcgcgaaatttgggcttctggaagccggttacaaagctgatttaaccatttgcgattacaactcgccgacgccgctgctggcagacaatatcgccgggcatatcgctttcggtatgggctcaggcagcgttcacagcgtgatggtcaatggtgtgatggtctatgaagaccgtcagtttaacttcgattgcgattccatttatgcacaagccagaaaagccgctgccagtatgtggcgtcggatggatgcgctggcataaatgacagatgccctcttcccgcagggaagagggttaaataaggaaagaagatgattgaacaatttttcaggcccgactctgtcgaacaggcgctggaactgaagcgccgctaccaggatgaagccgtctggttcgccgggggcagcaaactcaatgctacaccaacccgtaccgataaaaagattgccatttccttacaggatctggaactggactgggttgactgggataacggtgcactgcggattggcgcaatgtctcgcttgcagccactgcgtgatgcgcgatttattcctgcagcgctgcgtgaagccctcggttttgtttactcacgccatgttcgtaatcagtcgaccattggtggtgaaatcgccgcccgccaggaagagtcggtgctgcttcccgtcctgttggcactggatgctgaactggtttttggcaacggcgaaacgctgtcaatcgaggactacctggcctgcccatgcgatcgcctgctaaccgaaattatcattaaagatccgtatcgcacctgtgcgacccgcaaaattagccgttctcaggcaggtttaaccgtcgtgacggcagccgttgcaatgacagaccacgacggtatgcgaattgcgctggatggcgtcgccagtaaagcactgcgtctgcatgatgtcgaaaaacaaaatctggaaggcaatgcacttgaacaggctgtcgccaacgccattttcccgcaggaagatttgcggggcagcgtggcctataaacgctatatcacgggagttctggtagccgacctgtatgccgactgccaacaggctggggaggaagccgtatgatcatccactttactttaaatggcgcgcctcaggagctaaccgttaatccaggcgaaaacgtgcaaaagctgttgtttaacatgggaatgcactctgtacgcaacagtgatgatggtttcgggtttgccggttctgacgcaataatctttaacggtaatatcgttaacgcgtccttgcttattgccgcacagttagagaaggcagatattcgtaccgcagaatctctgggcaaatggaacgagttaagtctggttcaacaggcaatggttgatgttggcgtggtgcagtctggttataacgatccagctgcagctctgattatcaccgatcttctcgatcgcatcgccgcacctacccgcgaagagatcgacgacgcgctttctggtttgttcagccgcgatgctggctggcagcaatactatcaggtcattgaactggcggttgcacgtaaaaataatccgcaggccaccattgatatcgctccgactttccgtgacgacctagaagtcattggtaagcattatcctaaaactgatgccgcgaaaatggtgcaggcgaaaccctgctatgttgaagaccgcgtaacggctgacgcctgcgtcattaaaatgttacgtagcccacacgctcacgcactgattactcatctggatgtcagcaaagctgaagccttaccgggcgtcgttcacgttattactcacctgaattgcccggatatctactataccccgggtggtcagagcgcaccggaaccgtcaccgcttgaccgccgtatgttcggcaagaaaatgcgtcacgtcggcgatcgtgttgctgcggtcgtcgcagaaagtgaagaaattgcgctcgaagcactgaagctcatcgacgttgaatatgaagtgcttaagccggtaatgtcgatcgacgaagcaatggcggaagatgcgcctgtcgtgcacgatgaaccggtggtgtatgttgctggtgcgccagatactctggaagacgataacagccatgcagcccagcgcggcgagcatatgatcatcaacttcccgatcggttctcgccctcgcaaaaatatcgccgccagtattcatggtcatattggcgatatggacaaaggctttgccgatgccgatgtgatcattgagcgaacctataactcaacgcaagcgcagcagtgcccgactgaaacacatatctgctttactcgtatggacggcgatcgtctggttatccacgcctccacccaggtaccatggcacttacgccgccaggtcgcgcgcctcgtgggcatgaaacagcataaagttcatgtcattaaagagcgagttggcggcggttttggttccaaacaggacatcctgctggaagaagtgtgcgcctgggcaacctgcgtgaccgggcgtccggtactgttccgctacacccgtgaagaagagtttattgctaacacctctcgtcacgtcgcgaaagtcaccgtcaaactgggagcgaaaaaagatggtcgcctgacggcagtgaagatggatttccgcgccaacactggcccttacggcaaccactcactcaccgtaccgtgtaacggaccggcgctgtcgctgccgttatatccgtgcgataacgtcgatttccaggtcaccacctactacagcaacatttgcccaaatggtgcttatcagggttatggcgcaccgaaaggtaacttcgctatcaccatggcattagcggaactggctgaacagttacagatcgaccaactggaaattatcgaacgtaaccgggtacacgaagggcaagagctgaaaattctcggtgcaatcggtgaaggtaaagcgccgacctccgttccttccgccgccagctgtgcactggaagagatcctgcgtcagggtcgcgagatgatccaatggtcgtcaccgaaaccgcaaaatggtgactggcacatcggtcgcggcgtcgccattatcatgcagaaatcgggtatcccggatatcgatcaggctaactgcatgatcaaactggaatcggacggcacctttatcgttcattctggcggtgcggatattggtactggtctggatactgtagtgacgaaactggcagcagaagtgctgcactgcccaccgcaggacgtgcatgttatctccggtgataccgatcatgcgttgtttgataaaggcgcatatgcctcgtccggtacttgcttctcgggtaacgcggcgcgtttggcagcggaaaatctacgggagaaaattctgttccacggcgcgcaaatgttgggtgagccagtggcagatgttcaactggcaacgccgggcgtcgtgcgcggcaagaaaggcgaagttagtttcggggatattgcccataaaggcgaaaccggcaccggctttggttcactggtgggaactggcagttatatcacgcctgatttcgccttcccgtatggcgcaaacttcgctgaagttgccgtcaacacgcgtacgggtgaaatccgcctggataaattctacgccttgctggactgcggtacaccggtcaatccagagttagcgttgggacaaatctacggtgccaccctgcgtgctatcggccacagtatgagcgaagagatcatttatgacgccgaaggtcacccgttaacgcgtgatttacgcagttacggcgcaccgaaaattggtgacattccgcgtgatttccgcgctgtgctggtgccgagcgacgataaagtcggcccgttcggggcgaaatcgatctcggaaatcggtgtaaatggcgcagctccggcgattgctaccgcaattcacgatgcatgcggcatctggttacgcgaatggcatttcacaccggagaaaatactcactgcgctggaaaaaatataaataataaatggccgcttcggcggcctgtttctctgtttgaacgatgactaaatagtgactgcgaaaatgagataagccgttctcaaggcgtcctgcgccccaaattcgtgggaatttattttactaattcagatgatcaaatttactttaaaaggagtgaagggatgtctgatataaaccatgcaggttctgaccttatatttgaactggaggatcgccctccctttcatcaggctctcgttggtgccattacccatctgttggcaattttcgttccgatggtaacccccgcgttaatcgtgggtgcggccttacagctttccgctgaaacaactgcctatcttgtttctatggcgatgatcgcctctggtattggtacctggttacaagtaaaccgctacggcatcgtcggttctggcctactctcaattcagtcagtcaatttttcatttgttacggtcatgattgcgctgggcagcagcatgaaaagcgacggttttcacgaagagttaatcatgtcgtcgcttctcggcgtctccttcgttggcgcatttctggttgtcggatcttcatttatcttgccctatttacgtcgggttattacgcctaccgtcagcggtattgtggtactgatgatcggcttaagcctgattaaagtcggcattatcgattttggtggaggatttgcagccaaaagcagcggtacgttcggcaattacgaacatctcggcgttggtttattggttttaattgtggtgatcggctttaactgctgtcgcagtccgttgctacgcatgggagggatcgccattgggctatgtgtcggctatatcgcatcgttatgcctgggcatggtggatttcagcagtatgcgcaatttgccgttaatcaccatcccgcatccgttcaaatacggctttagttttagcttccatcagttcctggtggttggcacgatttatctgcttagcgtgctggaagcagtcggcgatatcaccgccacggcaatggtttcccgccgccccattcagggggaagagtatcagtcccggctgaaaggcggcgtgctggcagatggtctggtttctgttatcgcctccgctgtcggttcattaccattaaccacgtttgcgcaaaataatggggttattcagatgactggcgtcgcttcacgttatgtcgggcgaaccatcgcggtaatgctggttatcctcggcttatttccgatgattggcggcttcttcacgaccattccctcggcagttctgggaggcgcaatgacgttgatgttttccatgattgccatcgcagggattcgcatcatcatcaccaacggtttaaagcgccgtgaaacacttattgtcgccacttctttaggtttagggcttggcgtctcctacgatcccgaaatttttaaaatattgccagcctctatttatgtattagttgaaaaccctatttgtgctggcgggttaactgcgattttattaaatattatcctccctggtggctaccgacaggaaaacgttctgcctggtattacctcagcggaagagatggattaacagtaaaggagtcaatgatgtcaggagaacacacgttaaaagcggtacgaggcagttttattgatgtcacccgtacgatcgataacccggaagagattgcctctgcgctgcggtttattgaggatggtttattactcattaaacagggaaaagtggaatggtttggcgaatgggaaaacggaaagcatcaaattcctgacaccattcgcgtgcgcgactatcgcggcaaactgatagtaccgggctttgtcgatacacatatccattatccgcaaagtgaaatggtgggggcctatggtgagcaattgctggagtggttgaataaacacaccttccctactgaacgtcgttatgaggatttagagtacgcccgcgaaatgtcggcgttcttcatcaagcagcttttacgtaacggaaccaccacggcgctggtgtttggcactgttcatccgcaatctgttgatgcgctgtttgaagccgccagtcatatcaatatgcgtatgattgccggtaaggtgatgatggaccgcaacgcaccggattatctgctcgacactgccgaaagcagctatcaccaaagcaaagaactgatcgaacgctggcacaaaaatggtcgtctgctatatgcgattacgccacgcttcgccccgacctcatctcctgaacagatggcgatggcgcaacgcctgaaagaagaatatccggatacgtgggtacatacccatctctgtgaaaacaaagatgaaattgcctgggtgaaatcgctttatcctgaccatgatggttatctggatgtttaccatcagtacggcctgaccggtaaaaactgtgtctttgctcactgcgtccatctcgaagaaaaagagtgggatcgtctcagcgaaaccaaatccagcattgctttctgtccgacctccaacctttacctcggcagcggcttattcaacttgaaaaaagcatggcagaagaaagttaaagtgggcatgggaacggatatcggtgccggaaccactttcaacatgctgcaaacgctgaacgaagcctacaaagtattgcaattacaaggctatcgcctctcggcatatgaagcgttttacctggccacgctcggcggagcgaaatctctgggccttgacgatttgattggcaactttttacctggcaaagaggctgatttcgtggtgatggaacccaccgccactccgctacagcagctgcgctatgacaactctgtttctttagtcgacaaattgttcgtgatgatgacgttgggcgatgaccgttcgatctaccgcacctacgttgatggtcgtctggtgtacgaacgcaactaataataaaactttaacatcctcgtgaggacatcattatgtctggagacatcctacaaacaccggacgcaccaaagccacagggcgcgctggataattattttaaaattaccgctcgtggcagtaccgttcgtcaggaagtactggctggcttaacgacctttctggccatggtttattccgttatcgtcgttccgggaatgctgggcaaagcaggttttcctcccgcagctgtgtttgttgccacctgtctggtcgcgggcttcggctcgttgctgatgggattatgggctaatttgccaatggcgattggttgcgcgatttccttgacggcgtttaccgcattcagtctggtactcgggcaacaaattagcgttcctgtcgcactgggcgcggtatttctgatgggcgtcatcttcaccgccatttccgtaaccggtgtgcgtacctggatcttacgtaatttgccgatgggtatcgctcacggtacaggtatcggtatcgggctgtttctgctgctgattgctgctaacggtgtgggtatggttatcaaaaacccgattgaaggcttgccagtggcgctcggtgcgtttacctccttcccggtgatgatgagcttgctggggctggcggtcatcttcggcctggagaagtgtcgcgtacccggcgggatcttgttggtgattattgcaatttcgatcatcggcttaatctttgacccagcggtgaaataccacggtctggtggcgatgccaagcctgactggcgaagatggtaagtctctgattttcagcctcgatattatgggtgcactccagccaactgtacttccgagtgtactggcattggtgatgaccgcagtgttcgacgctactggcaccatccgtgccgtcgccggtcaggcgaatttgttggataaagacaaccagatcatcaacggcggcaaagccctgaccagtgactcagtaagttcaatattctccggcctggtgggcgcagcgcccgcagcggtttatatcgaatcagcggcaggaaccgccgccgggggtaaaacaggtttaaccgcaaccgtagtgggggcgttattcctgttaattctgtttttatcaccgctgtcatttttgatccctggttacgccactgcacccgctctgatgtacgtaggtttgctgatgttaagtaacgtctcgaagctggatttcaatgattttattgacgctatggctggcctggtgtgtgccgtgttcatcgttctgacttgtaatatcgttaccggtattatgctgggctttgtgacactggtcgtaggccgcgtctttgcacgcgaatggcaaaagctgaatattggtacggtgatcattactgccgcactggtcgcattttacgcgggtggttgggcaatctaatagattctccgcgcctttcagcgcggagatttctttcagagaggattctcaccgctggcaacaatacgctgctggcggactcgcctgagttctctttcagtaagcaactgcagcgcctgtgttgggcaagattcaacgcaggctggcccctcttcccgctgttcacagagatcgcatttcacaatttgttgtcgggtatcccccggcaacgactgaatggtgatcattccaaacgggcacgcactgacgcaactctgacagccaatacaacgggcagaattggtctgcaccacctgctcgcccatcgtcagcgcccccacggggcaagcgccaacacaaggggcgttttcacactgatggcacatcaccggcgcactgatgctgtccagtcgctgtaccttcagccggggtaaaaagacatcggcattcaactcctgttctgaagggtgagcgaccacacaggctacttcacaagtacggcagccaatacagtcagccggattaacgataattaacgatttcatcacgatgccttcgtatcaaacagagttaacatatcgcgcgccgcctgccttcctgcggccattgcagtgacaaccagatccgcgccatgaactgcatcaccaccagcaaagacttttttcagatgcgtctgggtaggtaaatacccgacgtcaccggtttgaatcaggccccatttatcgagtttaattccgctgccctgcaaccacggcatggcatgcgcctggaaaccaaaggccataatcagaacatcggcgggcaattcaaactctgaacccgctaccggacgaggacgacggcgaccatccggccccggctcacccatggcggtacgaatcaggcccaccgcagttaaacgcccatcttcgtcacaagcgatatattgcggttgaacattgaactgaaactcgacaccttcctcgcgcgcattaaccacctctttgcgcgagcccggcatactgacttcatcacgacgatacgcgcaggtcacgctggcggcattgaggcggatggaagtccgcaaacaatccattgtcgtatcgccaccgcccaataccacgactcgcttaccttccacgtccgtcagcggatactcttcagactccggcaatcccatgagctggcgggtatgggcagtcaggaacggtagagcctgaatgacaccgggcgcatcttcatgcggcagatctgctcgcatcatcccgtaagtccccacgccgatgaaaactgcatcatattcagaagttaaatcgctaaaggtaatatcgcggccaatttcacagttaagatgaaagtcgattcccattgcggtgaatatctctcgccgctggcttaataccgttttatcgagtttgaaaggaggaatgccaaaagtcagcataccgccaatttctggatggcgatcaaagacatcgacctgaactcctgcgcgcgccagaatatcagcacaccctaaccctgcaggcccagcgccaatcaccgccactttttcgctacggggaacaactttgctgacatcgggacgccagcccatcgccagcgcggtatcggtgatgtagcgttccagattaccgatagagactgcgcccgagtgatctttcaaagtacatgcgccttcacaaagacggtcctgtggacataccctgccgcaaatttctggtaaggaactggtctggtggcaaagttctgccgcttcaataatctttccttcctgtaccagacggatgtaatccggaatagcgttatgcagcgggcaatgccagttgcagttagctttttcggcacaataaacacagcggtcactctcataagtcgcttgttgtggatccagcccgcaatatatttcgccaaagtgggttttccgttcactcgctgaaattttatctgcgcctttacgcgagttaacggggagcaacgctgcactgcgagatggctgagcgtctgatgacgcttttcctgctgccgttttgcgctggcgggccacctttatctgctgcaaccctttatcgtccatcagtcgtaacgcctgtgttgggcaaacttcaatacaggcttgcgtgccggaactgcgctggttacaaaggtcgcatttctgcgcaatcgtatcgaccatctcaacgacgccaaaggggcaagcgattgcgcatcttttacaaccaatacatttttgctcgtccagttgtacgctatcggactggaaagtcagagcattaaccggacaagccgtaacgcaaggggcattgttgcagtgatggcaggccaccggattcgcagcctggcctttccctacaacgtggatacgcggtcgaaagtcactgtgactcagcggccagttttcttgattgtgtgccaccgcacaggcaatttcacaagcatgacagcctatacattccgcagcttcagcagcaataaacttattcatttgcatccctttcatttaatgagttatgtcttctcaaatttcgcgatgcaataaacgggcatatattaggtagcatgaccgttttaattataattttgcgactgagttcaaattattgcccctcaatctatgccgctttcattatttcaacattgccgatcaaaagagcgctatccagataaaaacgattaaatgcgagagtgcgacatgccagaatgattaatgaaatatcaatatgagaaaattacagataattccattgtcaggttctcttctcattttcgtggtttaaccacgattatgtgattgcctccgcaattcctgtctctaactccccttcctcgcaaaaactggcactccacgagcatgtgtttagacagtttcattaacgtaaacggttgctttttactctggcgggcgaaaggagaaacactgatgagcgccatagattcccaacttccctcatcttctgggcaagaccgcccaactgatgaggttgaccgcatattatcaccaggaaagctgatcatactcggtctgcaacacgtccttgtcatgtacgcaggtgcagtcgctgttcctcttatgattggtgaccgactgggcctctcaaaagaagctattgcgatgctcattagctcggatctcttttgctgcgggatcgtcacattattgcaatgtatcggtatcggccgctttatggggatccgcctgccggtgattatgtcggtgacctttgctgctgtaacaccaatgatagccattgggatgaacccggatatcggcctgctggggatatttggtgccactatcgccgcgggttttatcaccacattattagcgccacttatcggtcgcttgatgcctttattcccgccactggttaccggtgtggttattacttctatcgggcttagcatcattcaggtgggtattgactgggccgccggaggtaaagggaatccgcaatatggtaatcccgtttatttaggtatctcctttgccgtcttaatttttatcttgctcattactcgctatgcgaaaggatttatgtccaacgtcgccgtattactggggattgtatttggctttttactttcgtggatgatgaatgaagtcaatttatccgggctacatgatgcttcatggtttgcgattgttacgccgatgtcgtttggtatgccgattttcgatcccgtttccattctgaccatgactgccgtgttaatcatcgtgtttatcgagtcaatggggatgttcctggcactgggtgaaatagtcggtcgtaaactctcttcgcacgatattattcgcgggctgcgtgtcgatggcgtagggacaatgataggcggcacgtttaacagcttcccccacacgtcattttctcaaaacgttggcctggttagcgtgacgcgcgttcatagccgctgggtgtgtatttcttcgggaattatattaatcctgtttggcatggtgccaaaaatggcggtgctggtagcctccattccgcaatttgtgctgggcggcgctggtctagtgatgttcggcatggtactggcgacagggattcgaattctgtcgcgctgtaactacaccaccaaccgttacaacctctatattgtggcgatcagtctcggcgttggcatgactccgacgctctctcacgatttcttttctaagttaccggccgtactgcaaccgctgctacatagcggcattatgctcgcaacccttagcgccgttgtgctgaacgtcttctttaatggctatcagcatcatgctgacctggtgaaggaatccgtctctgataaagatttaaaagtcaggacagtacgtatgtggcttctgatgcgcaagctgaagaaaaatgagcatggagaataatatgaattttttaatgcgcgctatattcagtctgttgttgctttttactctctctattcctgtcatttctgactgtgttgcaatggccattgaaagtcgcttcaaatatatgatgctacttttttaaatggtttttacctgtcggcatccgctcaaaacgggcggttgtcgataaacgctcacttggttaatcatttcactcttcaattatctataatgatgagtgatcagaattacatgtgagaaattatgcaaacggaacacgtcattttattgaatgcacagggagttcccacgggtacgctggaaaagtatgccgcacacacggcagacacccgcttacatctcgcgttctccagttggctgtttaatgccaaaggacaattattagttacccgccgcgcactgagcaaaaaagcatggcctggcgtgtggactaactcggtttgtgggcacccacaactgggagaaagcaacgaagacgcagtgatccgccgttgccgttatgagcttggcgtggaaattacgcctcctgaatctatctatcctgactttcgctaccgcgccaccgatccgagtggcattgtggaaaatgaagtgtgtccggtatttgccgcacgcaccactagtgcgttacagatcaatgatgatgaagtgatggattatcaatggtgtgatttagcagatgtattacacggtattgatgccacgccgtgggcgttcagtccgtggatggtgatgcaggcgacaaatcgcgaagccagaaaacgattatctgcatttacccagcttaaataaaaaaaccccgacatttgccggggttgtgagcataacgtaatgcttattttaccggacgcatcgccgggaacagaataacgtcgcggatggtatggctgttggtgaacagcattaccatacggtcgataccaattcccagacctgctgtcggcggtaagccatgttccagtgcggtgacgtaatcttcatcgtagaacatcgcttcgtcgtcacctgcgtctttcgcggcaacctgatccaggaagcgttgcgcctgatcttccgcgtcattcagctcgctaaagccgttaccgatttcacgaccaccaatgaagaactcaaagcggtctgtgatttccgggttaacgtcgttacgacgcgccagcggagaaacttctgccggatattcagtaatgaaggtcggctgaatcagatgtgcttctgccacttcttcgaagatctcggtaacgatacggcccagaccccagctcttctcaacgtggatgccgatagattcagcaattgctttcgcagagtcgaagttgtccagatccgccatgtcggtttccgggcgatatttcttgatcgcttcacgcatggtcagtttttcgaacggtttaccgaagtccagcgtcacgtcgccgtaggtcacttccgtcttaccgagaatatcctgtgccagagtacggaacagcgattcggtcagctcgatcagatctttgtaatctgcgtaagccatgtagagttccatcatggtgaactctgggttatgacgtacggaaataccttcgttacggaagttacggttgatttcgaatacacgctcgaagccaccaaccaccagacgcttgaggtacagttccggcgcgatacgcaggtacatgtcgagatccagcgcgttatggtgggtgataaacggacgcgcagcggcaccgccagggatcacctgcatcatcggcgtttcaacttccataaagccgcggttcaccatgaactggcgaataccagagaggatctgcgagcgcactttaaaggtgttgcgggattcatcgttggagatgagatcgagataacgctgacgatagcgcgcttcctgatcctgcaagccgtggaatttatccggcagcggacgcagtgctttggtcagcagacgcaactcggtgcagtggatagacagttcgccggttttggttttgaacagcttacctttcgcgccgaggatgtcgccgaggtcccattttttgaactgctcgttataaacgccttccgggagatcgtcacgggcaacgtacagctgaatgcgaccgccaacgtcctgcagggtaacgaaagacgctttacccataatacgacgggtcatcatgcggccagcaacggcgacttcgatgttcagcgcttccagttcttcgttctctttgccgtcgaattctgcgtgcaattggtcagaggtatgatcgcgacggaaatcgttcgggaaggcaatcccctgctcgcgcaggttcgccagcttctcacgacgcgttttcagttcattgttaagatcgactaccgcgtcagcgccctgtgcgtgttgttcagacatgttggttcctcataaccctgctttcaaacttgcttcgataaattgatccaggctgccgtccagcacggcctgcgtgttgcgggtttctaccccggtgcgcagatctttaatgcgggagtcatcaaggacataagaacgaatctggctgccccagccgatgtcggatttgttatcttccatcgcctgtttctcggcatttttcttctgcatctccagttcataaagcttcgctttcatctgcttcatggcctgatctttgttcttgtgctgggaacggtcgttctggcactgggtcacgatcccggtcgggatgtgggtaatacgcaccgcagattcggtacggttaacgtgctgaccgcccgcgccggacgtgcgataaacgtcaatgcgcagatccgccgggttgatttcgatatcaatatcatcatcaacttccggataaacaaacgcggagctgaacgacgtgtggcgacgaccgccggagtcaaacgggcttttacgcaccaggcggtgaacgccggtttctgtacgcagccagccgtaagcgtaatcgccggagattttgatcgtcacggatttaatacccgccacttcaccttccgactcttcgatgatttcagttttgaaaccacgcgattctgcccagcgcagatacatacgctcaagcatgctcgcccagtcctgtgcttccgtaccgccagaccccgcctgaatatcgaggtagcagtcggcgctgtcatattcgccagagaacatacggcggaactcaagctgcgccagtttttcttccagggcgtcgagttcagcaacggcttcgttaaaggtttcttcgtcgtcagcttctacagccagttccagcagaccagaaacatcttccagcccctgtttcatttggtcgagggtgtcgacaacggcttcgagggaggaacgctctttacccagcgcctgtgcgcgttcgggttcgttccagacatccggctgttccagctcggcgtttacttcttccagacgctctttcttggcgtcgtagtcaaagataccccctaagaacgtcggagcgttccgtgaggtcctgaatgcgattatttaccggattaatttcaaacatggtctgatttcttttattgagctagtcaaaatgcggtgataagagcgggattgtacccaatccacgctcttttttatagagaagatgacgctaaattggccagatattgtcgatgataatttgcaggctgcggttgccgcgaaactcgttgatatcgagcttataagccagttgcacttcgcgcacgccgttatccggccagagggcggtatcgacattaaaagcaataccatccagcagtggaccgccgccgaccggttcgaccatcaccttcaaatgacgttcgcccaccagccgctgttgcagcagacggaaatgaccgtcaaacagcggctccgggaacatctgcccccacgggccagcatcgcgcagcagctgcgccacttccatggtcatttcggccgggcttaacggaccgtctgataccacttcgccttgcaatagcgaagggtccagccactcagtaaccagttcgccaaaccgttgttgaaagagtttgaatttatcctcttccagcgacaaacccgccgccatcgcatgaccgccaaacttcagcatcatgccagggtagagtgtgtctaatcgctccagcgcatcacgcatatgcagcccctgaatggagcgaccggaacctttcagcgtaccgtcacctgctggcgcaaacgcgataaccggacggtgaaaacgctctttgatgcgcgaagccagaataccgacaacgccctgatgccattcggggtgatacattgccagcccgccgggtagcgtgtcacggctgcgctccagtttctcgcacagggtcagggcttcaatttgcattccttgttcgatctcttttcgcgtctggtttagcgcatcgagttcatttgccagcacgcgcgcttcgccgatgttgtcgcacaacaacagcgccacaccgacggacatatcgtccagtcgtccggcagcattgagacgtggccccagcgcaaaacctaaatcgctggcggcgagtttttgtgcatcacggtttgccacttcaagcagcgctttaatccccggacggcactttccggctcggatgcgactcatcccctgccaggtcagaatgcgattattagcgtccagcggcacgacgtccgccactgtccccagcgcgaccagatccagcagttctgccaggttaggaattgcgatgttacgctcatcaaaccagccctgatcgcgcaaaaaggtgcgcagcgccagcatcagataaaacgccacacccacgcctgccagtgatttcgacgggaaattacagtcgcgcaagttagggttaatgatcgcttccgctgcgggtaatgtgtcgcctggcaaatggtgatcggtaacaataaccgggatgcccaacgagcgagcgtgctcaacccccgcatgggaggaaataccgttatccaccgtgacaattaactgcgcgccacgggcatgggcctgatcgaccacttccgggcttaagccgtaaccgtcttcgaaacggtttggtaccaggtagtcgatattgctgcaaccaagcgagcgcatcgccagcacgcttagagccgtgctggtcgcgccgtcggcgtcgaaatcaccgaccacaataatccgcgttccttcgcgaaaagcgttgtaaaggatctcaacggccttttcgacgccgctcagttgctgccagggcagcatacctttaacactgcgttccagttcttgcgcactgcgtactccccggctggcgtataaacggcgcagcaagggaggcaattcagcgggcaagtctgccgtttcatcgacttcacggcgacgaagttgtatctgttgtttcacgcgaattatttaccgctggtcattttttggtgttcgtcgaggaattctttcatctctttcggcggctggtaacccggaacaagtgtgccattgctcagcacaactgccggagtaccgctaacgccaagctggacgccaagtgcgtaatggtcggcaatatccacgtcgcaactggctggtgcgacgcttttacctgccatcacatcatcaaacgctttgtttttatctttcgcacaccagatagctttcatttctttctctgcatcgctgtccagcccctggcgcgggaaagcaagataacgcacggtgatccccagcgcgttgtagtctgccatttgctcatgcagtttgtggcagtaaccacaggtaatatcagtaaacacggtgatgacgtgtttttcctgcggcgctttataaacgatcatctctttttcaagcgcattcaactgctttaacagcatcttattggtgacattgaccggagccgtgccactaacgtcatacattggcccctgaatgatatgtttaccatcatcggtgatgtacaacacgccgctgttagtcagaactgtcttcatgccagctacaggcgcgggctgaatatcgctgcttttgatgcccattttggctaacgtttgttgaattgccgcgtcatcagcctgagcaaagcctgaaaacgccgctaacaaagtaaacaacataaaacctttcttcataaatcttcccgttcttttcagacatcacgcccgcgggtgatgctgttgatgaagttgccgcagacgctcggtagcgacatgcgtataaatttgcgtggtggagagatcgctgtggcccagtagcatctgcaccacgcgtaaatccgcaccatgatttaataaatgagtggcaaaagcgtgacgcaacacatgcggtgacagcttttcgctgtcgatacccgccagcacagcataatgtttaatacggtgccagaaggtctgtcgcgtcatctgctgcgcacgctggctgggaaacaacacgtcaattgacacaccattcagcagccacggacgcccatgttccagataggtttccagccagtaaaccgcctcttcacctaacggcaccagacgctctttgttgcctttaccaatgacccgtaccacgccctgacgcaggctgatatcactcattgtcagtccgaccagttcagagacacgcagcccggtagcatacaacacttcaagcatggctttatcgcgtagctccagtggctgatcgattaatggtgcctgtaataaacgttcgacctgcgcttcgcttaaatcttttggcaaacgctggggcaatttcggtgaagcgagatgcgcactgggatcgtcttcacgaaacttttcgcgataaagatactggaacaatcggcgcactgcactcagcaaacgcgctgagctggtggctttatacccgccctccagccgttctgccagtaatgcctgcaaatcgtcactttgcgccgtcgccagcgtcaacccgcggtgatgcaaccactccaccatcattgacagatcgcgacggtaagcgttcaacgtattttcagccagatttttttccagccacagagcatcaagaaactgctcgatgcgtgccagatcctgtttcacttgcgccccttatggtcactcatttgatccattatgccttattgtgccgtgactaaagcgattctgatacactagccgcaaaagccacagcagaatcgagaagcttacgttatgaatatgggtcttttttacggttccagcacctgttacaccgaaatggcggcagaaaaaatccgcgatattatcggcccagaactggtgaccttacataacctcaaggacgactccccgaaattaatggagcagtacgatgtgctcattctgggtatcccgacctgggattttggtgaaatccaggaagactgggaagccgtctgggatcagctcgacgacctgaaccttgaaggtaaaattgttgcgctgtatgggcttggcgatcaactgggatacggcgagtggttcctcgatgcgctcggtatgctgcatgacaaactctcgaccaaaggcgtgaagttcgtcggctactggccaacggaaggatatgaatttaccagcccgaaaccggtgattgctgacgggcaactgttcgtgggtctggcgctggatgaaactaaccagtatgaccttagcgacgagcgtattcagagctggtgcgagcaaatcctcaacgaaatggcagagcattacgcctgatctcactgacggcttagcgcatatgctttgccgtcatctttatctttgcgtctcttgttgcaacaaaatccgccgtaaatcccgccattcagcttcgtccatgctgtcggctgccagccataaatgttgccgtttaccgccatcagaacgtaaacgcagcatcatgccgctcttaatcatccacggtgctttgacgatgctccactcctgcccttgccaacgcaaacgcccgtccatcaacaagcgaatttccccctggcgagcattaatacgccgctggctgcgaacgcaatcaaacaccaccagcgaaagtaacaccatccataacggggtgtaactgagtggccagggcatgagtaaaataacagcggcaaccagcccatgaatcagcaaggaaagccactgtgcgcgccaggagacgcgcaaatcagattgccacaggaccacgttcccggttccgtgtctggatgagtcggaccatcatttccagttctgcatcggccggtttaccgtgattcatcagccagttaaacaggtccggatcgtcacattccagcagacgaataaagatgcgtttttcgtcatcgcttaagctgtcgtactcatgttcgaaaaacggcatgattgaaatatcgagttcgcgcataccacggcggcatgcccaatgaatgcgggctttgttgttaatgtccatcttcttcctgtctcacgaaaatccagtacccggctattgtaacgtgtttttcgccttcttttacgggaatatcagtaaacaccatcgcgatcgcgaaattaattcacaacaattcaatggcttcatttttttggaagtcgcctcgcagaaggcacagatcgcgtagtgaaagcacttgcattgcctcatagctcttttaccattagtcattaatacgccgttaagcaactcaggactctattatggcttttacaccttttcctccccgtcagcctacggcttctgcccgtttaccgctgacgctgatgacgcttgatgactgggcgcttgccaccattactggcgcggacagcgaaaaatatatgcagggtcaggtgacagcagatgtcagccagatggcagaagatcagcacctgctcgccgcccattgcgacgccaaaggtaaaatgtggagcaatttacgtctgttccgcgacggcgatggctttgcatggattgaacggcgcagcgtgcgtgaaccgcagctgactgaactgaaaaaatatgcggtattctctaaagtgaccatcgcgccagacgacgagcgtgtgctgcttggtgttgccggttttcaggcgcgcgccgcgctggcaaatctctttagcgaactgccttcgaaagaaaaacaggtagtcaaagaaggcgcgaccactttgctatggtttgaacacccggcagaacgtttcctgatcgtaaccgatgaagctactgctaatatgctgaccgataaactgcgcggtgaagcggaactgaacaatagccaacagtggctggcattaaacattgaagcgggtttcccggtgattgatgccgccaacagcgggcagtttatcccacaggcgaccaatctccaggcgctgggcggtatcagctttaagaaaggctgttataccggacaagagatggtggcgcgagcaaaattccgtggtgccaataaacgtgcgctctggttgctggcaggtagcgccagccgactgccggaagctggtgaagacttagagctgaaaatgggcgagaactggcgtcgtaccggtacggtactggctgcggtaaaactggaagatggtcaggtcgtggtacaggtcgtcatgaataacgatatggaaccggatagcatcttccgcgtacgcgacgatgcgaatacattgcatatcgagccgctgccgtattcgctcgaagagtaaatctctttatcgcatcaggcatttatcgcctgatgcgacgctggcgcgtcttatcatgtctgggatttgatgcctttatcacaacagggacgaggcccgtagatcggataaggcgttcacgccgaatccggcagttgtgctccgatgcctgatgcgacgctggcgcgtcttatcaggcctacaaaggcatacccattacgcctgcccaatatacaaatagatcgccagaaagtggcacacactaccgccgagcacgaagccgtgccagatggcatggttgtatggaatgcgtttgcagacgtagaaaatcaccccgagcgaataaaccacgccgcctaccgccagtaaggtaacgctgcccgccgcgagcttaactgccatttcataaattaccaccagcgacagccagcccatcgccagataggtcaccagagataaaattttgaatcggtgcgcgatggtcagtttaaacagaatacccagcaatgccaggctccagataacaatcatcaacccgcgcgctaacggagaatccagccccaccagcaaaaacggcgtgtaggttccggcaatcaacaggtaaatagcgcaatggtcaaatttcttcagccacatttttgcccgttgatgaggaatggcgtgatagagcgtcgaagcgaggaacagcaggatcatactgccgccatagaggctgtagctggttatcgctgtggcgctggcattaagatccaccgcctgaaccagtagcaacaccagcccaacgataccaaacaccaacccaatgccgtgactgacgctgttggctatttcctctgccagtgaatatccctgcttaatgaggggcttctgaaccataacttactccggagaaacgtacacgcacatgtatacctctccagcgtaactgagaatagttccagtgaacacctgttagctaaaataaattctgatttgagactaatctcctaaaaatcatgaaattaaatgcgaaatttcaactaacaggcgtgagttcaatttaaagacatttaaattcaatcacataaaattgtgtctgaccgggatagatgtcagcaatgacttttttcagttcagtcagggtcatattttcctgctctgcatgtttttcagtcagcgtatccagcgttacggttgaggttgcggtgacttcaatcgtgcaaaaataaccgtcatcttcaaaacgtccgacacgaagcacatcacccgttttgaagtgcgattcagactcgtcgcggatggtgatggttttacgcccagccagaatgtcatcctggaaacgttgaaaaaaagtgatgtcgtttggctgcatggtactatttcctgtaagaattgactcatctggagcctatgatagtgaaaaaactcaccttaccgaaagatttcttatggggcggcgcagttgccgctcatcaggtcgaaggcggctggaacaaaggcggaaaagggccgagcatttgtgacgttctgaccggtggcgcacacggcgtgccgcgcgaaatcaccaaagaagtcttgccaggaaaatactatccaaaccatgaagccgttgatttttatggtcactataaggaagacatcaagctatttgccgaaatgggcttcaaatgttttcgtacatccattgcctggacgcgcatttttccaaaaggcgatgaagctcagccaaacgaagaagggctgaagttctacgatgatatgttcgatgaactgctgaaatacaacatcgaaccggtgatcaccctctcccactttgaaatgccgctgcatctggtgcagcaatacggtagctggaccaaccgtaaagtggttgatttctttgtacgtttcgcggaagtggtatttgaacgctataagcacaaagtcaaatactggatgaccttcaacgaaattaacaaccagcgtaactggcgtgcaccgctgttcggttactgctgctccggcgtggtgtataccgagcatgaaaacccggaagagacgatgtatcaggtgctgcatcaccagtttgtcgccagcgccctggcggtgaaagctgcgcgtcgcattaacccggagatgaaagtcggctgtatgctggcgatggtgccgctctatccttactcctgtaacccggacgatgtgatgttcgctcaggagtcgatgcgcgaacgctacgtctttaccgatgtgcagctacgcggctattacccgtcctatgtgttgaacgagtgggagcgtcgcggatttaacatcaaaatggaagacggcgatctggatgtgctgcgtgaaggcacctgcgattatcttggtttcagctattacatgaccaatgcagtgaaggccgaaggcggcaccggcgatgcgatctctggttttgaaggcagcgtaccaaacccgtatgttaaagcatctgactggggctggcagattgatccagtaggtctgcgctatgcactttgcgaactgtatgagcgttatcagaggccgctgtttattgtcgaaaacggttttggcgcttacgacaaagtggaagaagatggcagcatcaacgacgactaccgcattgactacctgcgcgcccatatcgaagagatgaaaaaagcggtgacttacgatggcgtggatctgatgggctacacaccgtggggctgcatcgactgcgtgtcgttcaccaccgggcagtacagcaaacgctacggctttatctatgtgaataaacatgacgacggtactggcgatatgtcgcgttcacgtaagaagagctttaactggtacaaagaggtgattgccagcaacggcgagaagctttaagtcgatgaagtaccggatgcaatacttgttgcatccggtcagacaacttccctgttttatttcccgcccgccaaatcgataaaacttcccgtgacgtaagaggctttatcacttagtagccagacaatggcctgcgcgacctcttctgcctgtccaccacgctgcatggggatgttcgacttaacgcgatcgacgcgtccaggctcgccgccgctggcgtgcatttcggtataaataaaccctggccgcacgcagttaacgcggatcccctgcgcggcgacttccagcgatagtccggtggttaacgtatcaatcgcccctttcgatgccgcgtaatcaacatattcccctggcgaacccaaccgtgaggccaccgaagagacattgacgatagcgccgccactgccaccatttttaagcgccatgcgttttaccgcctcgcggcagcagagaaaatatcccgtcacgttggtggaaagtactcggttgattcgctctgcggtaaggttttcaacggtgcactgggtaaacaagatcccggcgttattgaccagcgctgctagcggttcatcgtgctgatcgattgctgtaaacatcgcaacgacctggttttcgtcgctgatatccgcctggagcacgaatgctttgccaccggcttgcgttattaagttcatcacttcctgcgccgcgtggaggttttgctgataattaaccgccaccgtatacccttcttgcgccaacagtaatgcagttgcccgcccgatgccgcgactgccaccagtcacaagtgctatagccatttgtttttccgagaaaaattaattcgttgacgtatctttgagattgctaacaaactggctcaatcttcaatgttggcacgcttttccccctcgccctttcagggagagggccggggtgagggtaaatattcgcgccagtgccggcctgttcccctcaccctaaccctctccccaaaggggcgaggggactgtctgagcacttttgtactttgtcatctgactaaaaaggcgccgaagcgcctttagaaaatagtcgaatcagtgaattactggtattcgctaatcggtacgcaggagcagaacaggttacggtcgccgtaaacatcatccagacgtttcactgtcggccagtatttgtctgccacacctgccgggaataccgcaacttcacggctgtacggatgcgcccactcggcgaccagttcgctctgaatgtgcggcgcgttcaccagcgggttatcttccagcggccagacaccggctttcacctggtcaatttctgcgcggatagccagcatcgcgtcgataaagcgatccagttccactttgctttcagattcagtcggttcaaccatcagcgtacccgccaccgggaacgacatcgtcggcgcgtggaaaccgtagtcgatcaggcgcttggcaatatccagctcgctgatgccggtttcttctttcagcgggcgaatatcgagaatacattcgtgcgccacgcgaccgtcgcgaccggtatacagcaccgggaaggcatcctgcaggcggctggcaatatagttggcgttgaggattgccacctggcttgcttttttcagcccttctgcgcccatcatgcggatgtacatccagctgattggcaggatagaggcgctaccgaacggtgccgcagaaaccgcgccctgacgggttaacatgccttcgatttgcaccacgctatgacccggtacaaacggtgccaaatgcgctttcacgccgatcggtcccatacccggaccaccaccgccgtgcggaatgcagaaagttttatgtaggttaaggtgtgaaacgtccgcaccaataaagcccggcgaggtgatgccaacctgggcgttcatgttcgcgccatcaaggtaaacctgaccgccgaactgatgcacgacttcacacacttcacggatcgtttcttcatacacgccgtgggtagaaggataagtcaccatgatacaggagaggttatcgcccgcctgttccgctttcgcgcgcagatcagtcagatcgatgttgccgtttttatcacacgccacaaccaccacctgcattcctgccatatgtgcagaagcggggttagttccgtgcgcagaagccgggatcaggcagatatcgcgatgcccttcgttgcggctttcatgataatgacgaatcgccagcaggcccgcgtattcgccctgtgcgccagagttcggctgcatacaaacggcgtcgtaaccggtcagtttcaccagccagtcagccagctgcgcaatcatctgctgataaccttcggcctgctccggcgggcagaacgggtgcagttcggcaaattccggccaggtgattgggatcatctcggcggcggcgttcagtttcatggtgcaggaacccagcgggatcatcgcctgattcagcgccagatctttacgctccagcgagtgcatatagcgcatcatttcggtttcgctgtggtagcgattaaacaccggatgggtgaggatttcgtcgtcgcgcagcatcgcaggctggatagagcggctgtcgtgagccacgtctttgtccagcgtgtcgatgtccaggccgtggttatcgcccagcagcacgttgaaaagctgcattacgttttcacgcgtggttgtttcatcaagggtgatcccaaccgcgttcagaatatcgctacgcaggttgatttcagccgcttcggcacgcgtcagtacgcccgctttgtcggccacttccacacacaaggtgtcgaaatagtgcgcatggcgcagtttcagacctttttgttgcaggcccgccgccaggatatcggtcagacggtgaatgcggttagcgatacgtttcaggccaaccgggccgtgataaacggcatacaggctggcgatgtttgccagcagtacctgggaagtacaaatgttggagttcgctttctcacggcggatatgttgctcgcgagtctgcatcgccatgcgcagcgcggtattgccagctgcatctttcgatacaccgataatacggcccggcattgagcgtttgtattcatctttcgccgcaaagaatgccgcgtgtgggccaccgtagcccatcggcacgccgaagcgttgcgccgaaccaaaaacaatatccgcgccctgtttacccggcgcagttaacagcaccagcgccataatatcggcggcaacgctgaccacaattttgcgtgatttcagttcgctaataagcgcagtgtagtcgtgaatttcaccggtagtgcctacctgctgtaacagcacgccgaagacgtcctgatggtcgagcactttttgcgcgtcatcgacaatcacttcaaaaccaaaggtttcggcacgagtacggaccacatccagcgtttgcggatgcacatcggaagccacgaagaagcggttggcatttttcagtttgctgacgcgtttcgccatcgccattgcttcggcggcagcggtggcctcgtccagaagagaagcagaggccatatccagtccagtcaaatccagcgttacctgctggaagttgagcagtgcttcaaggcggccctgggagacttcaggttgatacggagtgtacgcggtataccagcccggattttccagcatgttacgcaggataaccggcggtagctgcacggcggtgtaacccatgccgatgtaagacgtgaagcgtttattgcgactggcaatagccttgagttctgccagtgcggcgtattcggtcgccggtgcgccaacctgcggtggtgtcgcaagttgaatatctttcggcacaatctggccggtcagcgcgtttaacgattgtgcaccaacggcattcagcatttcttgctgttgcgcggcgtccggtccgatatggcgttcaataaaagcgccgctgttttcaagctggcttaacgtctgtgtcatgagcgatggttcctgaaacgtgcagtgaattgtgaacctctctccttacgaagagagtgagggtgaggcataaattttcctcaccctgatcctctcccgcagaagaggaataaagccgttactcgtcttctaacaatgcttcgtatgcggtcgcatccagcagtgattccagttcgctttcatcgctggctttgattttaaagatccagccgcctgcatacggttcgctgttcaccagttccggggaatcgctcagtgcgtcgtttaccgccacgatttcaccgcttactggcgcataaatgtctgacgccgcttttaccgattcggcaaccgcgcagtcatcgcccgcgctaaccgttgcgcccacttccggcaggtcaacaaacaccatatcgcctaacagctcctgagcatgttcggtaataccaacggtgtaagtgccgtcggcttctttacgcagccattcgtgttctttgctgtatttcagttctgctggtacgttgctcatcaatcaatctccaaaaaagtaaatcacgcgacggctttgccgttacgcacaaaaacaggttttgtcactttaaccggcatttcacggttgcgaatttgcacaatcgccgtttcgccaataccttccggcacgcgcgccagcgcaatgctgtaacccagcgtcggggagaaagtaccgctggtgataatgccttcatgctggttgccctgcgcatcggtaaagcgtaccggcagttcattacgcagcacgcctttttcggtcatcaccagaccaaccagtttttctgtaccatgctcacgctgcacttccagggcttcacgaccgataaagtcacgatctgccggttcccaggcgatggtccagcccatgttggcggctaaaggagagatggtttcgtccatctcctgaccataaagattcatgcccgcttccagacgcagcgtgtcacgcgcgcccaagccacatggcttaacacccgcttccaccagcgcacgccagaaatcggccgctttttcattgggcagcgcaatttcatagcccgcttcaccggtataaccagtggtggcaataaacagatcgcccgcctgcacgccaaagaacggtttcatcccttccaccgcctgacgctgggcgtcattaaacagtgtggcagcttttgcctgcgcattcggcccttgcacggcaatcatggaaaggtcatcacgaacggtaatttcgatgccgaaaggttcagcgtgttgggtaatccaggagaggtctttttcgcgggtggcggagttaacaacgaggcggaagaaatcttcagtaaagtagtagacgatgaggtcatctatcacaccgccagaggcattcaacatccccgagtaaagggctttgccgcttttggtgagcttcgccacatcgttcgccagcagataacgcagaaactcccgggtgcggctgccgcgaagatcgacgatggtcatatgtgacacatcaaacattccggcatcggtacgtaccgcatgatgttcgtcgatttgcgaaccgtaatgcagcggcatcatccagccgtggaaatccaccatgcgagcgccgcaaagcgtgtgttgttcgtacaaaggagtctgttgtgccatcttgtcctcattgaataagcggggctgacaactttttcatggtgaaattatcaccacgaaacccagcatcggagccactcccggtccccaacgcaatcgttctcttttgcctgaacttaccaccgaaacagactgttaaccataaggtaaaattgatcatcacattagcttatggttaaaaaatgcaaaaatcgcgacagaataaaaaaccaaaaaatacaccagtttctatacaaagatgatgtgatgagaaagtcaatttgaataagacaatattaagagctaaaaaaatgtcaaaaaacactaaatcaaaaaataatggcattagaaaatataatgcgaaaacggaggtgaaattagtttatttcaaatgaggaaaatctcccggcgaaaaaaccgggagatgaaagtgtgatgggtatcaaataaacaacagaggagaaatttttaacgcagccattcaggcaaatcgtttaatcccattgcctggcggataagttgcggcttaacgccaggaagcgtgtcggccagtttcaaaccaatatcacgcagcagttttttcgccggattggtaccggaaaacagatcgcggaatccctgcataccagccagcatcaacgccgcactgtgcttgcggctacgctcatagcgacgcagataaatgtactgcccgatgtctttcccctgacgatgcaaccgtttcagttcggcaatcagctctgcagcatccataaagccgagatttaccccctgccccgccagcgggtgaatggtatgtgcggcgtcgcccaccagcgccagacggtgcgaggcaaactggcgcgcataacgccccgtcagtgggaacacctgacgcgcgctctcaaccttgcataagcccaggcgattatcaaaagcgatatttaacgcgcgattaaattcgtcttcacttgcctgctgcatccgctgcgcttcctctggcgacagtgaccagacaatcgagcaaagatgcggatcgctaagcggtaaaaaggccagaatgccttcgccatggaaaacctgccgcgccaccgcatcatgcggttcttccgtgcgaatggtcgctaccagcgcgtgatgctgataatcccagaaagtcagcggaatatcggctttgttgcgcaaccaggaattagcgccgtccgcgccaatcaccagacgcgccgttaacatgctgccatctttcagcgtcaggaaggtttcattttctccccaggcgacctgctgtaattctgcgggggctaacagagtgatatctgacgactgatgcgctttgttccacagcgcgtagtgaatcactgaattttcaacgatatgcccaagatggctatagcccatgctttgatcgtcaaacgaaatgtgaccaaagctgtctttgtcccacacttccataccgtgataacagctggccctacgagagagaatgtcctgccagacgccaagacgggtgagtaatttttcgctggcggcattgatagccgaaacgcgcagttgtggtggtgcattcgccgccagaggttcctgtacgcgctgctccagtacggcaacgcgtaagccgctcccctgtaagccacaggcaaccgccagccccaccatgccgccgccaacaatggctacatcaacactttgcattgtttattccttaaaaccgccttcaacgcgccacccaaccgagggtgcgctgcgccagcacatcgcgtgccggggtgaataattccatcgtcatcagcccgatgttgcgcccgacaaccagcggtgcccaacggttggcaaaaagatgtacaaggctgtccgtgacgccaatggttgcttcgcgatcgctctgtcgacgctgctgataacggcacaatacgccgtaatcccccatgtcttctccgcgctcctgcgcctgagtcagggtttccgcaagactcatcacatctcgcataccgaggttaaacccttgcccggcaatcgggtgcagagtttgcgccgcattgcccaccagcacggtacgatgggtaatagatctggcggcgtgggttaacgccagcggataagcactgcgtttaccagcgtgggtaattttcccaagtcgccagccaaaggccgactggagttcacggcaaaacttctcgtcactccacgacaacacctcttcgcgccgttccagtggatgacaccagaccagcgaacagcgtccgtcagacatcggcaacatcgccagcgggccatgttgcgtaaagcgttcaaaagcgcgcccttcatgcgcaacggaagtagcaacgttggcaatcacggccagttgttcgtaaggctcctgctgccagtcaacgccgcacgcggtggctaacgctgaatgggtgccatcagctgctaccagcacgcggcccgtcagcgtctcgccactctccagcgtcacttcaacgtgactctgagtacgggcaacgttagccacgcgatcagggcaatgcagcgttacgccaggtgctttacgcagcaatgcaaacagccgttgcccgacattgtgcaattcgacaacctgtcccagcgccgccagttggtaatcttctgcggcgagggtgacaaatccagcgtgaccacgatcgctgacatgcacggtggtgatggcagttgcgcaatccgccagagattgccagacgccgatgcgcgccagttgctgacaggtacccgccgccagcgctatcgctcgtccatcaaagcccggatgagcatgtgactctggcgcagtcgcttcaatcaaatgtaccggcagcgccccgtgacttaaccgggaaatagccagcgccagcgtcgcgcccgccatgccgccaccgacgatgattacgctcattgctttctcgcagcaaccatcaacgcttcgatttcttccggctttttcaccacgctggcggtgaggttttcgttaccggtttcggtaatcacaatgtcgtcttcaatacgaatgccgataccgcgatattgttctggcacttctgcatccggcgcaatatacagccctggctctacggtcagtaccatgcccggttccagaatgcgcgagcgatcctgaccataaacacccacgtcatggacatccagtcctaaccagtggctaaggccatgcataaagaaaggacgatgggcgttctgagcgatcagttcatcaacatcacctttcaggatgccgagttttaccaggccgctaaccatgatgcgcaccacttcaccagtgacttccagaatggaagttcccggacgatacaggcgcaggctggtttcgagagactccagcacaatgtcgtagatttcacgctgggcctgggtgaatttgccgttgaccgggaaggtgcgggtaatatcgccagcgtaacctttgtattcacaacccgcgtcaatcaacaccaggtcgccgtcgcgcatttcacactcgttttcggtgtagtgcagaatgcagccgttttcaccgctgccgacaatggtgttataggacggatagcgcgcaccgtggcggttaaattcgtggtgaatttcgccttccagatggtactcgaacattcccggacggcatttttccatcgcccgtgtatgtgccatggcggtgatttctcccgcgcggcggagtacggcaatctcttctggcgatttgaacaggcgcatttcatgaacaacaggacgccagtcgatcatcgttgccggtgcggtgagattttgccgcgaacctttacgcagtttttccagcgcactgttcacgattacatcagcatatgcatattcgccctgggcatggtaaaccacatccaggccgttaagtagttgataaagttgctgattgatttcgctgaatgccagtgcgcggtcaacgcccagtttctctggcgcggcatcctggcctaagcgacggccaaaccagatctccgccgtcaggtcgcgaacgcggttaaacagaacgctgtggttatgagtgtcatcgcttttaatcagcaccagcaccgcttccggttcgttaaagccggtgaagtaccagaagtcactgttctgacgataggggtattcgctgtcggcgctacgtgttacttctggtgcagcaaaaatcagcgcggcgctgccgggttgcatttgctccaccagggcctgacggcgacgctgaaactcttgccgggatatctcactcataacactctccttacgttttttgtttttagtgtagagtcggtttttgtacttctggcgcggtcggttgcggatgagtaaaggtgtcgtggcataacagcgcggcaacacgaacgtattcgatgatctcttcaagcgacatttcaagctcttcctgatcttcgtcttcgtcgtaacccagttgcgcaatgttacgcagatcgtcgatagcttcaccggtttcgccggtcactttatccagcttcggttgcgtaacgccaagaccaagcaggaagtgattgacccaacctgccaatgcatcagcccgatcgaaaacgctgacatcatcgccatcaggcagataaagctgaaaaaggaagccgtcatcctgcagggcatcgctggtggcagagtgcattttacgcagtgcctgtgccagctcatgaccgaaagccatgccttcgttcgtcaggtcgtgaagtagcggtagccatgagctgtcatcgttaccgccacatatcatcccgctgattaaaccatgcatctcagctggggtcagacccgtcccttgttggttcagatactggttcatttcgttgtaaccaggcatttcgttctgtatagacataagcattcgtcgtcaaagggaggaatattcatgatatgctaccactttgggccctggtggaccagaaaagggcttgtctcttctcatcagggtagctatagtgtcgccccttcgcagaccatgggtctaaagacgaaggcagcgcagtcaatcagcaggaaggtggcatgtctgcacaacccgtcgatatccaaatttttggccgttcactgcgtgtgaactgcccgcctgaccaaagggatgcgttgaatcaggcagcggacgatctgaaccaacggttgcaagatctgaaagaacgcactagagtcacaaatactgaacagttggtcttcattgccgcattgaatatcagctatgagttagcgcaagaaaaagcaaagactcgtgactacgcggcaagtatggaacagcgtattcggatgctgcagcagaccatagaacaagcgttacttgaacaaggtcgcatcaccgaaaaaactaaccaaaactttgaatgacacttttcggtttactgtggtagagtaaccgtgaagacaaaatttctctgagatgttcgcaagcgggccagtcccctgagccgatatttcataccacaagaatgtggcgctccgcggttggtgagcatgctcggtccgtccgagaagccttaaaactgcgacgacacattcaccttgaaccaagggttcaagggttacagcctgcggcggcatctcggagattcccttcttatctggcaccagccatgacgcaactaccagaactcccactgacattatcccgacaagaaatccgcaaaatgattcggcaacgtcgtcgtgcgttaacgccggaacaacagcaggaaatgggtcaacaagccgctacccggatgatgacttatcccccggtggtgatggcacatacggtcgctgtattcctctcttttgatggcgaactcgacacccagccactcatagaacaactctggcgcgccggtaagcgcgtatatcttccagttttgcatccctttagtgccggtaatttgctgttcctgaattaccatccgcaaagcgaactggtgatgaacaggttgaagatccatgagccaaaattggatgtgcgtgacgtgctacccctttcccgattagacgtgctgatcacaccgctggtcgcctttgatgagtacggtcagcgcctgggaatgggcggtggtttttatgatcggaccttacaaaactggcagcactataaaacgcaaccggtgggttatgcgcatgattgtcagttggtggaaaaactccccgttgaagagtgggatatccctcttcctgcggtggttacaccgtcgaaagtctgggagtggtaagggcgatacacccgcatcgccctgattgacatcgttgattctttgacctaatttagtgagtaagggtaagggaggattgctcctcccctgagactgactgttaataagcgctgaaacttatgagtaacagtacaatcagtatgatgacaagtcgcatcataacccttctccttcaagccctcgcttcggtgagggctttaccgttacagccccatgctgccctgccatcgtaaatccccattaaataaacacaacgcattgatctgactttgatttattttctggagcagactcgcaaagtagaatgcgcaacgcggcaacggtgtggagaagggataaaaaaacgggcaagtcagtgacctgcccgttgattttcagagaaggggaattagtacagcagacgggcgcgaatggtacccggaatagctttcattgcctgcagcgctttttcggcaacgtcttcgtcggcttcaatatcaataaccacataacccatctgggcggaagtttgcagatattgcgcggcgatgttgacgccctgctcggcgaagattttgttcagcgcagttagcacgcccggacggttttcgtggatgtgcatcagacgacgcccaccgtgcagtggcagcgagacttccgggaagttcaccgcagagagcgttgagccattgtcagaatacttgatcaatttacccgcaacttccaggccgatattctcctgcgcttcctgagtcgaaccgccaatgtgtggcgtcagaaggacgttgtcgaattcacacagcggagaggtaaatggatcgctattggtcgccggttccgtcgggaatacgtcgattgccgcccccgccagatgtttgctcgccagcgcatcacacagcgccggaatatccaccacagtaccgcgcgaagcattaatcagcagcgagccgggcttcattagtgaaatttctttcgcgcccatcatatttttggtggacggattctctggtacatgcagactcaccacatcgctcatattcagcaggtcagaaagatgctgtacctgagtggcgttgcccagcggcagtttattttcaatatcataaaagtaaacatacattcccagcgattcagccagaatgcccaattgcgtaccaatatgaccgtagccgatgatacccagctttttgccgcgcgcttcaaaagaacccgccgccagtttgttccacacgccacggtgcgctttagcattggcttccggcacgccgcgcaatagcagcagcagttcgccaatcaccagctccgcaacagagcgcgtatttgagaacggtgcgttaaataccgggatcccgcgctttgccgccgcatccagatcaacctggtttgttccgatacagaaacagccaatagcgaccagtttttctgcggcgttgatcacgtcttcagtcagatgggtacgggatcgcaggccgatgaagtgggcatcgcggatggattcttttaattgttcatcatccagcgcgcctttgtgaaattcgatgttggtgtaaccagctgcacgaaggctttccagcgccttttggtgcacgccttctaccagcagaaacttaatcttgtctttctccagcgatacctttgccatttacccaatcctgtcttttgaaatgttgtgtgcggatttgcatccgcctttcaacatatcaaaaaataatattgcggcaatatgaacgtttgcgtcgcgatgttgaggaaatatcacgcaaaggtaattcttggatgaatatgctggtttagaggatttatttagagcaatcgacaattgcctggtaaaagcgtgacacatgtcaccaaatttaatgaagagaatttttttaacgggggaggttcccccgtcagatcatttcacaatggttttgacaccgtcaggtgtgccaatcagcgcaacgtccgcgccacggttagcaaacaagccaacagtcaccacgccaggaatcgcatttatggcgttttccatcgctatcgggtcaaggatttccatgccgtggacgtcgaggatcacgttgccattatcggtcaccacgccctgacggtattccggacgaccgcccagtttcaccagctgacgcgccactgcactacgtgccatcgggataacttctactggcagcgggaatttacccagaatatcaacctgcttggaagcgtctgcaatacagataaatttttctgcaaccgaagcaatgattttttcacgggtcagcgccgcgccgccgcctttgatcatttgcatgtggccgttgatttcatctgcgccatcaacgtagatgccaaggctgtcgacttcgttgagatcaaaaacgtgaatgccgaggcttttcagtttttcagtggaagcatctgaactggaaacggccccttcaatctggcctttcattgtaccgagcgcgtcaataaagtgtgcggcggtggaacctgtacctacaccaacaatggtgccgggctgaacatactgaagtgccgcccatcctactgcttttttcaattcatcctgcgtcatgatcgtttcgcctgtggtatgaaatttcacacgcattatatacaaaaaaagcgattcagaccccgttggcaagccgcgtggttaactcatccataaaatatcgcgcaatggcaggcatcccctttcgccccgcaaataaagcatacaacggtctgggtatgccgctccacggtgcaaacaggcgcaccagttcaccgttcgcaagcccctgtttacaggcaaattgaggcaataacgccacgccattcaacacaaccagggcgcgaactcgctgagcgaaatgcattagcgcaaatccctgatcttttaagctgcgcttttaaccacggatacaaatgttacccgccgacggcttcggtatatgcaacctgacacaaaattgtgtcatagtgcaggaaaaagcatttaccaggagcagacaacagcaatgaaacgcccggactacagaacattacaggcactggatgcggtgatacgtgaacgaggatttgagcgcgcggcacaaaagctgtgcattacacaatcagccgtctcacagcgcattaagcaactggaaaatatgttcgggcagccgctgttggtgcgtaccgtaccgccgcgcccgacggaacaagggcaaaaactgctggcactgctgcgccaggtggagttgctggaagaagagtggctgggcgatgaacaaaccggttcgactccgctgctgctttcactggcggtcaacgccgacagtctggcgacgtggttgcttcctgcactggctcctgtgttggctgattcgcctatccgcctcaacttgcaggtagaagatgaaacccgcactcaggaacgtctgcgccgcggcgaagtggtcggcgcggtgagtattcaacatcaggcgctgccgagttgtcttgtcgataaacttggtgcgctcgactatctgttcgtcagctcaaaaccctttgccgaaaaatatttccctaacggcgtaacgcgttcggcattactgaaagcgccagtggtcgcgtttgaccatcttgacgatatgcaccaggcctttttgcagcaaaacttcgatctgcctccaggcagcgtgccctgccatatcgttaattcttcagaagcgttcgtacaacttgctcgccagggcaccacctgctgtatgatcccgcacctgcaaatcgagaaagagctggccagcggtgaactgattgacttaacgcctgggctatttcaacgacggatgctctactggcaccgctttgctcctgaaagccgcatgatgcgtaaagtcactgatgcgttactcgattatggtcacaaagtccttcgtcaggattaatccatcaaataatgcctgatagcacatatcaggcgttgtcctcacttctttttgtattccttgaatcacatcacaaaatagacaaatctcaggcggcaaaaaacgacgtctgaatgcattttttttgctggcgacaaacccacgtaaaaagctcaccgtaggcgcaaataccctcattttgattgcgttttacggagcaaataatgtctaacgtgcaggagtggcaacagcttgccaacaaggaattgagccgtcgggagaaaactgtcgactcgctggttcatcaaaccgcggaagggatcgccatcaagccgctgtataccgaagccgatctcgataatctggaggtgacaggtacccttcctggtttgccgccctacgttcgtggcccgcgtgccactatgtataccgcccaaccgtggaccatccgtcagtatgctggtttttcaacagcaaaagagtccaacgctttttatcgccgtaacctggccgccgggcaaaaaggtctttccgttgcgtttgaccttgccacccaccgtggctacgactccgataacccgcgcgtggcgggcgacgtcggcaaagcgggcgtcgctatcgacaccgtggaagatatgaaagtcctgttcgaccagatcccgctggataaaatgtcggtttcgatgaccatgaatggcgcagtgctaccagtactggcgttttatatcgtcgccgcagaagagcaaggtgttacacctgataaactgaccggcaccattcaaaacgatattctcaaagagtacctctgccgcaacacctatatttacccaccaaaaccgtcaatgcgcattatcgccgacatcatcgcctggtgttccggcaacatgccgcgatttaataccatcagtatcagcggttaccacatgggtgaagcgggtgccaactgcgtgcagcaggtagcatttacgctcgctgatgggattgagtacatcaaagcagcaatctctgccggactgaaaattgatgacttcgctcctcgcctgtcgttcttcttcggcatcggcatggatctgtttatgaacgtcgccatgttgcgtgcggcacgttatttatggagcgaagcggtcagtggatttggcgcacaggacccgaaatcactggcgctgcgtacccactgccagacctcaggctggagcctgactgaacaggatccgtataacaacgttatccgcaccaccattgaagcgctggctgcgacgctgggcggtactcagtcactgcataccaacgcctttgacgaagcgcttggtttgcctaccgatttctcagcacgcattgcccgcaacacccagatcatcatccaggaagaatcagaactctgccgcaccgtcgatccactggccggatcctattacattgagtcgctgaccgatcaaatcgtcaaacaagccagagctattatccaacagatcgacgaagccggtggcatggcgaaagcgatcgaagcaggtctgccaaaacgaatgatcgaagaggcctcagcgcgcgaacagtcgctgatcgaccagggcaagcgtgtcatcgttggtgtcaacaagtacaaactggatcacgaagacgaaaccgatgtacttgagatcgacaacgtgatggtgcgtaacgagcaaattgcttcgctggaacgcattcgcgccacccgtgatgatgccgccgtaaccgccgcgttgaacgccctgactcacgccgcacagcataacgaaaacctgctggctgccgctgttaatgccgctcgcgttcgcgccaccctgggtgaaatttccgatgcgctggaagtcgctttcgaccgttatctggtgccaagccagtgtgttaccggcgtgattgcgcaaagctatcatcagtctgagaaatcggcctccgagttcgatgccattgttgcgcaaacggagcagttccttgccgacaatggtcgtcgcccgcgcattctgatcgctaagatgggccaggatggacacgatcgcggcgcgaaagtgatcgccagcgcctattccgatctcggtttcgacgtagatttaagcccgatgttctctacacctgaagagatcgcccgcctggccgtagaaaacgacgttcacgtagtgggcgcatcctcactggctgccggtcataaaacgctgatcccggaactggtcgaagcgctgaaaaaatggggacgcgaagatatctgcgtggtcgcgggtggcgtcattccgccgcaggattacgccttcctgcaagagcgcggcgtggcggcgatttatggtccaggtacacctatgctcgacagtgtgcgcgacgtactgaatctgataagccagcatcatgattaatgaagccacgctggcagaaagtattcgccgcttacgtcagggtgagcgtgccacactcgcccaggccatgacgctggtggaaagccgtcacccgcgtcatcaggcactaagtacgcagctgcttgatgccattatgccgtactgcggtaacaccctgcgactgggcgttaccggcacccccggcgcggggaaaagtacctttcttgaggcctttggcatgttgttgattcgagagggattaaaggtcgcggttattgcggtcgatcccagcagcccggtcactggcggtagcattctcggggataaaacccgcatgaatgacctggcgcgtgccgaagcggcgtttattcgcccggtaccatcctccggtcatctgggcggtgccagtcagcgagcgcgggaattaatgctgttatgcgaagcagcgggttatgacgtagtgattgtcgaaacggttggcgtcgggcagtcggaaacagaagtcgcccgcatggtggactgttttatctcgttgcaaattgccggtggcggcgatgatctgcagggcattaaaaaagggctgatggaagtggctgatctgatcgttatcaacaaagacgatggcgataaccataccaatgtcgccattgcccggcatatgtacgagagtgccctgcatattctgcgacgtaaatacgacgaatggcagccacgggttctgacttgtagcgcactggaaaaacgtggaatcgatgagatctggcacgccatcatcgacttcaaaaccgcgctaactgccagtggtcgtttacaacaagtgcggcaacaacaatcggtggaatggctgcgtaagcagaccgaagaagaagtactgaatcacctgttcgcgaatgaagatttcgatcgctattaccgccagacgcttttagcggtcaaaaacaatacgctctcaccgcgcaccggcctgcggcagctcagtgaatttatccagacgcaatattttgattaaaggaatttttatgtcttatcagtatgttaacgttgtcactatcaacaaagtggcggtcattgagtttaactatggccgaaaacttaatgccttaagtaaagtctttattgatgatcttatgcaggcgttaagcgatctcaaccggccggaaattcgctgtatcattttgcgcgcaccgagtggatccaaagtcttctccgcaggtcacgatattcacgaactgccgtctggcggtcgcgatccgctctcctatgatgatccattgcgtcaaatcacccgcatgatccaaaaattcccgaaaccgatcatttcgatggtggaaggtagtgtttggggtggcgcatttgaaatgatcatgagttccgatctgatcatcgccgccagtacctcaaccttctcaatgacgcctgtaaacctcggcgtcccgtataacctggtcggcattcacaacctgacccgcgacgcgggcttccacattgtcaaagagctgatttttaccgcttcgccaatcaccgcccagcgcgcgctggctgtcggcatcctcaaccatgttgtggaagtggaagaactggaagatttcaccttacaaatggcgcaccacatctctgagaaagcgccgttagccattgccgttatcaaagaagagctgcgtgtactgggcgaagcacacaccatgaactccgatgaatttgaacgtattcaggggatgcgccgcgcggtgtatgacagcgaagattaccaggaagggatgaacgctttcctcgaaaaacgtaaacctaatttcgttggtcattaatccctgcgaacgaaggagtaaaaatggaaactcagtggacaaggatgaccgccaatgaagcggcagaaattatccagcataacgacatggtggcatttagcggctttaccccggcgggttcgccgaaagccctacccaccgcgattgcccgcagagctaacgaacagcatgaggccaaaaagccgtatcaaattcgccttctgacgggtgcgtcaatcagcgccgccgctgacgatgtactttctgacgccgatgctgtttcctggcgtgcgccatatcaaacatcgtccggtttacgtaaaaagatcaatcagggcgcggtgagtttcgttgacctgcatttgagcgaagtggcgcaaatggtcaattacggtttcttcggcgacattgatgttgccgtcattgaagcatcggcactggcaccggatggtcgagtctggttaaccagcgggatcggtaatgcgccgacctggctgctgcgggcgaagaaagtgatcattgaactcaatcactatcacgatccgcgcgttgcagaactggcggatattgtgattcctggcgcgccaccgcggcgcaatagcgtgtcgatcttccatgcaatggatcgcgtcggtacccgctatgtgcaaatcgatccgaaaaagattgtcgccgtcgtggaaaccaacttgcccgacgccggtaatatgctggataagcaaaatcccatgtgccagcagattgccgataacgtggtcacgttcttattgcaggaaatggcgcatgggcgtattccgccggaatttctgccgctgcaaagtggcgtgggcaatatcaataatgcggtaatggcgcgtctgggggaaaacccggtaattcctccgtttatgatgtattcggaagtgctacaggaatcggtggtgcatttactggaaaccggcaaaatcagcggggccagcgcctccagcctgacaatctcggccgattccctgcgcaagatttacgacaatatggattactttgccagccgcattgtgttgcgtccgcaggagatttccaataacccggaaatcatccgtcgtctgggcgtcatcgctctgaacgtcggcctggagtttgatatttacgggcatgccaactcaacacacgtagccggggtcgatctgatgaacggcatcggcggcagcggtgattttgaacgcaacgcgtatctgtcgatctttatggccccgtcgattgctaaagaaggcaagatctcaaccgtcgtgccaatgtgcagccatgttgatcacagcgaacacagcgtcaaagtgatcatcaccgaacaagggatcgccgatctgcgcggtctttccccgcttcaacgcgcccgcactatcattgataattgtgcacatcctatgtatcgggattatctgcatcgctatctggaaaatgcgcctggcggacatattcaccacgatcttagccacgtcttcgacttacaccgtaatttaattgcaaccggctcgatgctgggttaatgactcgtcccgtcacgatcttcagcaatatgctgaagcatcgtggcggtataacgatgatttctgattgaataaagatattcctgcatatacatcggcctgtgcggtgcatcaaaatatttcagcgttgccggattcaccagtcgccaggcaaaatgcgggatcaccgtcagaaaatgtccgcgctccacggcgctgattttggccataaaactgtagggacgataaataatggttggattgatcccacaaggtcgcatattcgcatcaatcattgcttcgaagttggcccggttctgaaagcgcatttgtagccagggcagctcctgaagcagctcttgctcttgtcgctcttcataacggcgagaaacgagaaagcctaatcgcagcggtggtagttcactgatagtcaggttttccagttcctgaactcgtgcagatacatgctgtggggagataataaaatctaactggcggtcaaaaagattatcgataacgccattttcgctgaactcaactggctgggcggtcacgccttcatacttatctccgagactaatcaactgatcgaaaataattgtcggataagtattatctatgccaatcacaatttctcgtgaacgacgccctgagttatggatttcattatcaatcgcagaaagccgttgataaaccgggaacagtttttgatacagttcctgtccggctttattgaggctgatattattatctttgcgggtaaatagcgtatagccaatttgttcttccagcgcggcaatgcttttaccaaatggcgaagccgtcatatggattttttctgccgcccgggcaatattattggtttgcgctaataaaatgaaattgcgcatctttttcgaaataaaaatgtccatccccctcccccgcatccttgtccgcttaaccgtttcagtcagcctatccttgatgaaaccgcgagcaaagataggtgattacgtcatggttttacagaaaattacagaaaaaggaggcaatatcgggtaaaggcattagcccgacgaatacgtcgggctacaaatattattgtgctgcaggtgttttagcgggttgttgatccacaggttctaactggaagaccacatcgacctgatcatcaaactgaatagcggcctgctcgtaagtttcctgggcggacaccggcgcggcatcggctttcatcatccgcaccattgggctgggctgatagttggaaacatggtagcgcacgctatataccggccccagtttacgatgaaagccgttcgccagttcctgcgcctgatgaatcgcgttatcaatcgctgccttacgcgctttgtctttataggcatccggctgcgccacgcccagcgacacagaacgaatttcgttaagacccgccttcagcgcgccatccagcaaggaattcagtttgtctaactgacggagcgtgacttccaccgttctcacagcgcggtagcctttaaggatacttttaccatcctgataatcataatctggctgggtgcgtaagttcgctgagctgatatcttttttcgcgatctgattgagttcaaggaaggaaatgtattgtgcgacgcgctcatctgcctgtttcttggcagtagcggcatccttcgcggccacgttaacttcaatcgcaagagtggcaatgtctggcaccgcatccacgcttgccgtaccggaggtgacaatatgcggtccatccggcaattcgttagcctgcgctgccatcccgctaatacccattaatgccgccagggcgataactttgaacttcacgttagtctctccgtgttaattgacttgcccaaaattcaggacctctggaggcaagcttagcgcctctgttttatttttccatcagatagcgcctaactgaacaaggcttgtgcatgagcaataccgtctctcgccagctgcaaggcaataaaccacataacacatcccacaaccagattgataatgcgctgtgcttttgccgtgcgcagacgcggtgccagccaggctgcgagaagagccagaccaaagaaccacaggaaagaggcgctaattgtcccgagtgcaaaccagcgttttggttccacatcaagttgcccgccaaggctgcccagtacaacaaaagtatccaggtaaacatgcggattcagccaggtcactgccaacatggtggcgataattttccatctgccttgcttcatgacttcggcgctggctaactcaatattactgctcattgctgttttaaaagcgccaaaaccataccacagcaagaaggctacgccgccccaggtgaccagcgccagcaaccacggcgactgcatcaataacgcgctgccaccaaaaatcccggcgcaaatcaggaccaaatcgctgatagcacaaagtaaggcaatcataatgtggtactgacgacgtatgccctgattcatcacaaaagcattttgtggaccgagcggtaggatcatagccgccccaagtgcaagaccttgaaagtaataagaaaacacgttggatattccgaattaagtatctgatgcagagactatatcgcgggattgttattagcggaaattgataatattaattggcaatcagaaaaactaataagagagaggccagagagtattatctggcctcagcgttgattacgcagctttgtcttctttcacccgcttaaagttcacatccatttgcgggtacgggaagctgataccggcggcatcaaattcacgtttaatacgctccagcacatcccagtacacgttttgcagatcgccgctgttgctccagacgcggaccacgaaattaatcgacgatgcaccaagttcgttcaggcgcacagtcatttcgcgatctttcaaaatgcgatcttcagactggataatattggtcaggatctgcttaacctgatcgatatcggaatcatacgccacgccaataataaattcgttacggcgaactggctcgcgggagaagttaataatatttccggcaataattttaccgttcggaataacgataattttaccgtctgcagtacgcatggtggtggagaaaatctgcacactcagcacagtaccggctacgccgcccaggtcaacatattctccggcacggaacgggcggaacatgacaagtaacacgccagcggccaggttagacagtgacccctgcaaagccagaccaacagctaagcctgcggcaccgagtacagcaatgactgacgcggtttgtacacccacgcgtcccagtgcagcgattagcgtaaaggcgataataccgtaacggactaatgcagaaagaaaatcagcaacagtggcatcgattttacgggagatcatcaggcgattcaccgcgttggaaatcatccgcgcgataatcaaaccaacgatgatgatcgcgagtgccgccacgatgtttactgcataacttagcagcagcgcctggttagctaccagccagcttcccgcgccgtttatgctatcgacaacattcaaatcttccattcaatattccttttcaactgactcaaaatggagaaatacactccgccgccttatgacgggcagtctgacaagggtaaacaataaagcataattttgccaaatagatcacagatttctcatctgaatcaccttgcttttggcgaaaaaatccccgcagagcggggctcagacagatatcaatgtgcgctttgtcatgccggatgcggcgtgaacgccttatccggcctacaaaaacctgcaaattcaatatattgcaggatacgtgtaggcctgataagcgtagcgcatcaggcaattttgcttttggcgaaaaaaagacccgcagagcgggccttgagataagcagaaaggaatatcttacagaacgtcgatcgcgttcagttcctggaatgctttctccagacgagcgatcatcgaagtctgaccggcacgcagccatacgcgcggatcgtagtatttcttgttcggctgatcttcgcctttcgggttacccagctgaccctgcagataagcttcgttcgctttgtagtagttcagaacgccttcccaggttgcccattgggtatcggtatcgatgttcatttttactacgccgtagcttacggagtctttgatttcctgagcagtagaaccggaaccaccgtggaatacgaagttcaggctgttgtgcggcaggttgtgtttcttggaaacatattcctgagaatcacgcaggatggtcggagtcagaaccacgttacccggcttgtaaacaccgtgtacgttaccgaaggacgctgcgatggtgaaacgcgggctgattttgctcagttcggtgtatgcgtaatcaacgtcttccggctgggtgtacagtgcagaagcgtccatgtggctgttgtccacgccgtcttcttcaccaccggtgcaacccagttcgatttccagagtcatgccgattttggacatgcgctccaggtatttagagcagatttcgatgttctcttgcagagattcttcagacaggtcgatcatgtgagaagagaacagcggcttaccggtagctgcgaagtgtttttcacccgcgtccaacagaccgtcgatccacggcagcagtttcttcgcgcagtggtcagtgtgcaggataaccggaacaccataatgttcagccatctggtgaacgtgatgcgcaccagagatcgcgcccaggatagcagcaccctgcggaacgtcagatttcacgcctttaccagcgataaaggaagcaccaccgttggagaactgaacgataaccggcgctttaactttagcagcggtttccagtacggcgttgatggagtcagtaccgacgcagtttactgctggcagtgcgaagttgttttcttttgctacctggaaaactttctgtacgtcatcaccagtgattacgccaggttttacgaaatcaaaaatcttagacatgtctcttgtcctgtatcgtcgggccttatactcgtcatacttcaagttgcatgtgctgcgtctgcgttcgctcaccccagtcacttacttatgtaagctcctggggattcactctcttgtcgccttcctgcaactcgaattatttagagtatgaaaaattgcgtgctctaaaagcgcgctgaaacaagggcaggtttccctgccctgtgattttttacttcttagcgcgctcttcgagcatcgctactgcaggcagtactttaccttccacgaattcgaggaatgcgccgccgccagtggagatgtaggagattttgtcagcaatgccgaacaggtcgattgctgccagagtgtcgccgccgccagcgatggagaacgcttcgctgtctgcgatagcgttagccacgatttcagtacctttgcggaagttcgggaattcgaacacgccaaccggaccgttccacagaatggttttcgcattcttcaggatttcagccagttcctgagcggaagcatcaccgatatccaggatctgctcgtcagctttcacatcgttaacagatttcagggtagccggtgcagtttcagagaactcggttgctacgcgaacatcagacggaaccgggatgttgcaggtggtcagcagacgtttagcttcgtcaaccaggtcagcttcgtacagggatttacccacatcgtggccttgtgccgcgataaaggtgttagcgataccaccaccaacaatcagctggtcagcgattttagacagggagtccagaacggtcagtttggtagatactttagaaccaccaacgatagccaccatcgggcgagcaggttctttcagtgctttacccagcgcgtccagttcagctgccagcagcgggcctgcgcacgcaacgtcagcgaatttaccgataccgtgagtagaagcctgcgcgcggtgagcagtaccgaatgcgtccattacgaacacgtcacacagtgcagcgtattttttggacagggtttcgtcgtctttcttctcgcctttgttgaagcgaacgttttccagaacaaccagttcaccttcagcaacgtcaacgccgtcgaggtaatctttaaccagacgaaccgggttagacagtttgtctttcaggtagttaacaaccggcagcagagagaattcttcgttgtactcgccttcggtaggacgacccaggtgggaagttaccatcacttttgcgccttgtttcagggccagttcgatggtcggcagagaagcacggatacgcgcgtcgctggttactttcccgtcttttactggtacgttcagatccgcacggataaatacacgtttcccagcaagatccagatcggtcatcttaattacagacatggtgaatcctctcgttgattctaaaagttttgcagacgctgcttgcgtcttacctgaaagcaacagtagccatagctaacgtcgtgtcgagcattcggttagcaaagccccattcgttatcgcaccagaccaacgttttgatcaggtgtgcgccactgacccgggtttgggtgccatcgacaatggcactgtgcggatcgtggttaaaatctacagagaccaacggcaattccgtatagtcaactataccatgaaatgcaccttgtgctgctttttgcagcaacaggttgacttcattggcttttacaggtttcttcaccgtcacgcttaaatcgattgccgtcacatttatggttggcacacgtaccgcaatcgcttcaaagcgatcgttaaattgcggaaaaaatcgtgtgataccggcggccagtttagtatcgaccggaatgatcgactggctggctgcccgggtgcgacgcaggtcaggatggtatgcatcaataacctgttgatcgtgcatggcggagtgaattgtggtcacagtgccggactcaataccgtacgcatcatctaacaatttgatgacgggaattatgcaattcgtggtacaggaagcgttagaaacgatgcggtgttccgcacgaagttgatcctgattgacgccgtaaacaacggtcgcgtcgagatcgttactgccaggatgtgaaaagagcacttttttggccccggcggcaatatgcgcttcgccatgctcgcgggagccatatacgccggtgcagtcgaggactacatcaacgccaagttcacgccaggggagcgattgcagtgaacgttcatgcaatacgcggatggcgtcatcaccaacaaaaagttgatcgcgttcctgtcgtacttcccatgcaaaacggccatggctggtgtcatatttcaacaaatgcgccatgcccgcagcatccgccagttcgttgattgccaccacggtaatttccgcccggcgtccggattcatacaaagcacgaaccacattacgcccgatgcgaccgaagccatttatcgctacgcgtacggtcatagatctcctgcaaggttttccctgagcaaatttgccagacagagtaatccagcaaatcgtccggggaaaccttacctgtcgcaaactgcgactgattggttaattgtcgaacatttaatcgactgaaacgcttcagctaggataagcgaaacgtggaataaaaggaatgtttgtccagccgaagaagacatttatctgactcacatcacacttttatccccttttgtgggaagctttattccaggctggcgtaataataaccctacaataactggaataaattgtcagcttgtgaagtgataccggccttcttcagtcatctctactatcagattggcctgacggctattcatcagcacacgctcgacattggggccatcggtgcgggcataaaatgcttcggctacttgccgcgttaatcctcccgcaattttacgactaatcaagcgctcccgcagaatttgagcaggtgcatgaataaaaatagaaaaatcgcagaaagatgccaactccagccacttttcatcatccagtaacaaccagtttccttcgacgatgacgagtggtgcggtaacgtgcaacgcatcttcaacaggatcatgcttttgtcgatcgtactgcggccacgtacaatccccttccacgacctggcgcagattttccgtcagtttcgcaacgtcaaatgtctctggtgcgcctttgaaggggcgcaattgatgcgcatccagccagctattgtaatggtgaaaaccatccatcgggagcgtctgaatagcgggcagttccgggtcttgttgcgcgagatattcccagaaggtggttagggttgatttacccgtccccggcggagcgcaaagaaaaaccaccgtacgccgctgcggatttaccgtctgtaaggccgccaacatgtgcagcaacggtttatgtacattttcaatctcttcgttctggtactgtgcctgtatcttcagcccattcaccgttaattcaattttcacggcgttaattcctttaaggtggtcgttactgccagcgtcagcgccgttttgaccattccgctaaaacgcgcctctgaccagacggagaaatcagcgaacttcatcgcttttaacgcgtcatagagcatcgcattgcgggttatgctattgacgttgctgataaaatcccaggtcatgtcatcggcaaatccgggcgtttcatcctgttcgttcaggtaatgccagaactgggaaaaatgcgtgatatcggcgtacaaccatttatccattttccccaacgcataaatcaaacgcagtgcaacatcaatatcgtcaagcgggccgctttgggcgagtaacggcttcactgcatattccacgatctcttcatcgttatcgacaaacagcgacggcagaaactggcgtatcccctggagcaaaatggtatgcgcagttttcataaatgaaaataaattgtcctgtgcatccagttgctcaagcacatcatcttctgtcagcgtcgccattggtcttccgatagatcaccatcaatgcagggagtctattatattacacgtttggtccgcgccgccgatcagtaatgtctgcgtccgcaccccattcgccgtctgttggataccgttcaccagctcaccgcccgtcacgcccgtagcgctaaagaggatatcgttccccctcaccagttcatcgagcgagtacacacggttaacgtcaacgcccattgccttgcaacgcttgcgctcctgctctgcaatctgccgattttccgtgtaatcccctttagcctggcaaaagtcaatcagctcggcctgcatatccccgcctaatgctttaacggcacaggcagaaatcacgccttctggcgcaccgccgatggtgtacatcacatcgtaaggattatcctgccagcaggtcagcacgctggcggcgacatcgccatccggcagggcaaaaaccttcacgcccagctgtgttgcttcctcaatcgcggcactcaggcgcggtttatccagcgtaaccatgcgcagcttatccagcggtttgcctaacgctttcgccacgttgcgcaggttgtccgtcagaggcaaagacagatcaatcgcgcccgccgccagccgattaacaaccagctttttcatatacatatcgggcgcatgtaacaggctatctcgaggggcgaaagccatgaccgccagcgcattgctctgccccatcgccaccatccgcgtgccttcaatgggatcaaccgcgatatcgacttctggcccatcgcctttgcccacctcttcgccaatccacagcatcggcgcatggtcaatttctccttcgccgataaccactcgtccacgaaaagcgacgtcgtttaatgcctggcgcatcgcggtgaccgccaggccatcaattttatttttgtcgccacatccggtttgcggccaggcagccaacgctgcctgttccgtaacgcgaaataatggccacgccagggacatcattgcgcggcctccccgatatcaacgccaaattgtgccagcagatatttctcggcctgttcattccagatgccgtgcgtttcctcaaccagccgcgccaactctttaaacagcggatcggttttgcctttttcggcaaaatcggcaatggcagtgagcggcatggtcacgccgttataaatgagttttttaccgccagggatatccggcagattgagcacggtttctggcaccgcatccaggccaccgatatgggtcaccataaacgacggctgtaactgcccagtggcgctaagggcaatcgcctctttcatgtcgtccgttgaaccgccagatgtaccgacgacgtgcgtgctgttgtaatggacgttgtagaaattaaacggcactttgaagtttttatccgtcggcccggcaaagaagttcagacagccatcttccgccagtaattcatcagccatctcaacgacagcaggcaccgccgcataaacaaaaatgtcatcgaacccggcatctcctgtcagcgcccgcagcatctggacaggatcgctcatccctttggtattcacatacaccagctcaatgcctttactggccgccagttccaccggcagcagcttctgtacctgcgccagacgtttgtcgtcgatatcgaccaccaccacccgcgacggttgtatgccgccgttaatggcgtaatcgatagcgccaatgcccatcggacctgcacacgccagcagtgcaatattgccgccaggtttgacgcccatgcgatgctcataaacatattgcgtggtgtgataattggcatgataagcaccaataatgcagcacataggctctgccagcgacgccgcagcaaaataagagccgtgatacggtaatacgcagcccaaattaatggcgatttcgggaataatcatataagtggcattgccgccaaaatattcgtagctgtagcccgctgaatatccgcttggtaaccccatcgccggttgcaatacaaaacgctggccttttttatatttgccagtgagatttttacccacttcgacaataaccccggcacattcatgcccggtaatgaccggatgattttctaaatcgtcgggtacgcgtttatgttcactaccgagtaacgccgctttccaggtcgataaacagacgctgtcagaaattacactcaccagtaattcattatcggtaatttctggcagttcaaatacgcgcagacggacatcccgcttgccataaatagcagcaactttggttttcatttttacctctgtaatcagtgtttatgttcggcggttaattgattaaataaagtgtcgagttttggatcgccaatatagttattaatcaatatcagtggtttatccgtcacacgtttcacgcgcccttccagactggcatgagtaacgacgatatccgcatccgcaggcacgttttctatggcgtaatgttttacttcaattgccagccccgctttttccaggcgtttacggaaggtggtcgcgcccatcgcactggagcccatccccgcatcgcaaacaaaggcgatacgcttaaccctgcttaacgagaatgcaccctcttgtttcatcgccttaaccgcattggctgactgagcaaactcatcttcgctctccgtttccaccgttttttccatcttcagtatcagcgaagtaatagcaaaggacaccagggtacctaccgtaacaccggcaattgtcgccaggaacgagcctttcggcgtcagtgccaggtaagcaaagatagaccccggacttgggccagccaccagaccaccgtccagtaagttaaacatccaggtgccagacataccgcccgcaatcatggcaataatggtcagcggcttcatcagcacatacgggaaatacagttcgtggatcccaccgaggaagtgaataatcatcgccccgggcgcagaacgtttactcatccctttaccaaacaaggtaaacgccagcagcagccccaggcccggacctgggttagaggccaccataaagaagatggatttaccgttaaccgaagcctgttgcattcccagcggataatagacgccctgatcgatcgcattattgaggaaaagcactttcgccggttcattgatgactgacaacaatggcagataacccgcatgtaccagcgcctcaatacactctttgacgaaagtattggcaattaacaccgccgggccgataacttcaaaacccagcagacaaaggagcatccccgcgatacctaatgagaagttattgataaccatctcaaaaccggcaggtatgcgtttttccagtgccttatcgacatattttatgaccaacccaccgagcggccccatgatcattgagccaaggaacatcgggatctctgcgccaacgatcacaccaatagtacctattccgcccatgaccgccccgcgtttaccgccgaccagatgaccacctgtagaaccaatcatcacgggcaataaataggtaatcatcgggccgacaattttggcgaaatgttcgttaggcagccaaccggtgggaataaataacgcagtaataaaaccccaggcaataaaagcaccaatattggggatgaccattgcagtcaaaaagcccccaaaagcctggacctttgcacgagcagacttgttttccataatattatcctgtagaggagagagtaattatccgcggctgataatgtccgctaattgtttttctgatgatgctgttaagagttgttcgagtatttcttcttcgcacagtaattcacttaacgcctgaatagcgccaatgtgcgaatcggcatcggcagcagagagtccgatgagtaatttaattggttcgtcattccccggaaaataaacaccttgttcaagtaatgtcaaagacatcccggttttaagcgccccacattccggtcgcgcatgaggcattgccacgcctggtgcgagaatataataagggccattgttaatggtggaatctttaattgcctgaatgtaattctcgctgatatagtttttatccagcaatgataccatcgagaaatcgatagcttcctgccaatcttttgctgaatgtataactgagattgatgattctggaaaataatcactaagccgcataaattatccttattttatttttagggtaccgtccggcggtaaaaataaaatactcgtgcggtttaatgaaagcaattgagcagggaaaccggtgttttgaaaacagtgaattattaatttcttatataacattgagttatagatataacaacaaatgtcaatacgcatatcgtgatgcatattacataattgatatttattgcatataaatatttgtgatctacaacacgccttatctattgcttgtccgcaaacggacatatcaaggtaataaaaaaggtcgccgaagcgacctttttacccgaaatgctaattacagcagttcttttgctttcgcaacaacgttatcaacagtgaagccgaactcttcaaacagcagctctgccggagcagattcaccgaaggtggtcataccgacgatagcaccgttcaggccaacatacttgtaccagtagtcagcaatacccgcttctacagcaacgcgtgcagtaaccgctttcggcagtacggattcacggtaagcagcatcctgcttgtcaaatgcgtcggtagacggcatggacaccacgcgcgctttcacgccttcggcagtcagtttttcgtaggcagcaacagccagttcaacttctgaaccggtagcgatgaaaatcagttccggctgaccggcgcagtctttcagcacataaccaccgcgcgcgatgtttgccagttgctcttcagttcgttcctgctgcgccaggttctgacgggagaggatcagtgcggtcgggccgtcctgacgctcaacaccgtatttccacgcgaccgcggattcaacctggtcacacggacgccatgtagacatgttcggggttacgcgcagagaagcgacctgctcaaccggctggtgagtcgggccgtcttcgcccagaccgatggagtcgtgggtgtaaaccatcacctgacgctgtttcatcagcgcagccatacgtacggcgttacgtgcgtattccacgaacatcaggaaggtggaggtgtacggcaggaagccaccgtgcagggagataccgttagcaatcgcggtcataccgaactcgcgaacaccgtagtggatgtagttacccgcagcatcttcgttgattgctttagaaccagaccacagggtcaggttagacggcgccaggtcagcagaaccgccgaggaattccggcaacagcggaccgaacgcttcgatagcattctgagacgctttacggctggcgattttcgccggattagcctgcagtttagcgatgaactctttcgctttagcgtcgaagtcagacggcatttcgcctttcatacggcgggtaaattcagcggcttcctgcggataagctttcgcgtaagcagcgaatttctcgttccatgcggattctttcgcctggcctgcttctttcgcatcccactgagcatagatttcagacgggatttcgaacggcgcatatttccagcccagttgttcgcgggtcagggcaatttcagcgtcgcccagcggcgcaccgtgggagtcgtgggtaccggctttgttcggggaaccgaaaccgatgatggttttgcacatcagcagggaaggtttgtcagtcactgcgcgcgcttcttctactgcgcgtttgatagatgccgcgtcatgaccgtcgatgtcgcgaataacgtgccagccgtaagcttcgaaacgcattgcggtgtcgtcggtgaaccagccttcaacgtgaccatcgatagaaataccgttgtcatcgtagaatgcaatcagtttacccagcttcagcgtacccgccagagagcaaacttcgtgggagatgccttccatcatgcagccgtcgcccatgaaggcgtaggtgtagtggtcgacaatgtcgtggcccggacggttaaactgcgccgccagcgttttttctgcaatcgccataccgactgcgttggcaataccctgacccagcggaccggtggtggtttccacaccagcggtgtaacccacttccgggtgacccggagttttagagtgcagctgacggaagtttttcagttcttccatcggcagatcgtaaccggtgaggtgcagcaggctgtagatcagcatggagccgtggccgttggacagcacgaagcggtcacggtcagcccaggacggattctgcgggttgtgtttcaggaaatcacgccacaggacttcggcaatgtcagccatacccataggggcacccgggtgaccggatttggctttctgtactgcgtccatgctcagcgcacgaatagcattggcaagctctttacgtgaggacattttgactccagatcggatgatgaagggcacgcccttaacgacttgacgacagcgcgttttgggctacgccggaaaatttgccaacaatttaccgcaagccgcgcgtcatgtacatggaacatccttttgccgcttcagaaatctctggatcatgctcgcatgttgcgcaatctactcgcccgtccgctgcgcttttccttatactgagactgagcgtcgattcacctgcaaacggcgcatttttagaataatcctgaccttgtgcggaagagaaaacatgaaaattcgcgccttattggtagcaatgagcgtggcaacggtactgactggttgccagaatatggactccaacggactgctctcatcaggagcggaagcttttcaggcttacagtttgagtgatgcgcaggtgaaaaccctgagcgatcaggcatgtcaggagatggacagcaaggcgacgattgcgccagccaatagcgaatacgctaaacgtctgacaactattgccaatgcgctaggcaacaatatcaacggtcagccggtaaattacaaagtgtatatggcgaaggatgtgaacgcctttgcaatggctaacggctgtatccgcgtctatagcgggctgatggatatgatgacggataacgaagtcgaagcggtgatcggtcacgaaatggggcacgtggcgttaggccatgtgaaaaaaggaatgcaggtggcacttggtacaaatgccgtgcgagtagctgcggcctctgcgggcgggattgtcggaagtttatctcaatcacaacttggtaatctgggcgagaaattagtcaattcgcaattctcccagcgccaggaagcagaagccgatgattattcttacgatcttctgcgccaacgcggcatcagcccggcaggtcttgccaccagctttgaaaaactggcaaaactggaagaaggtcgccaaagctcaatgtttgacgaccatcctgcatccgccgaacgcgcccagcatattcgcgatcgcatgagcgcggatgggattaagtaaagcctggtggtgtcgaacgtaggtcagataaggcgttcacgccgcatctgacatgaatggcacatttgttaccttgtgcgcattgccggatgcgatgctggcgcatcttatccggcctacgggtgccgaacgtaggtcggataaggcgttcacgccgcatccgacattaatggcacgttttacccgtgcgcatcgcatctggtgcttactcgccctttttcgccgcctgaatatacagcatttccagcgccagcgttgccgctgccagagcagtgatttccgactgatcgtatgccggagccacttccactacgtccatcccaacaatgttgagatctttcaggccgcgtaccagtttaatagcgcgatcggaggtcaggccgccaatcactggcgtaccggtgcctggtgcaaaagcaggatccaggcagtcgatatcaaaagtcaggtaaaccggcatatcacccacaatctgtttcacttgggcgataacgtcatccacgctgcgatcgttcacctggcaggcgtccagcacggtaaagccgttgtctttatcaaactcggtacgaataccaatctgcacggaatgattcgggtcgatcagaccttctttcggcgcggtatagaacatagtgccgtggtcaaattcacaaccgttcgcataggtatcggtgtgggcgtcaaagtgtaccagcgccattttgccgaaatgcttcgcatgagcacgcagcagcggcagcgtaacaaagtggtcaccaccgaaagagagcatacgcttaccggcagccagcagcttctcggcgtgcgcctgcagcttttcgctcatctcacgggcatcgccaaaggcatataccagatcgccgcagtccacgacgttcagacgctcacgcatgtcgaaattccacgggaagcggttgtgttcccaggccagattcgtcgaaacctgacggatcgctgccggaccgtggcgaccacccgcacgaccagaagtggccatatcgaacggcacgccagtaatcacccagtctgcatcgctgtcatacggctggaagttcatcggcaggcgtaaaaaaccaaaggcattggaaaccagtgagttatcgtattgatgacctaaggtgctcatggatggactcctattacaaagtcgatataaaaaaacccttccgcgtcgttaggcccgacgaggaagggttggatttgtcacaataaattgtggcggattatcaccgctaaattaagcggattcaagtaacacaggacttactcatcttcaagataagtataaccgtacaaacctgcctcgaactcttcaaggaactgttgttgcagttcagcatcaagatcggttttcttcacttgatcgcggaactgggttaacagcgttttcggatcgagctgtacatattgcagcatgtccgccacggtatcgccttcgtcagacagttctacttctacgctaccgtcagggaagacgaacacgtcaaccgcttcggtatcaccgaacaggttgtgcatgttgccgaggatctcctgatatgcgccgaccataaagaaaccgagcatcggcggattctctggatcgtactccggcattggcattgtcgtggcaataccgtcaccatcaatatagtggtcgatagcaccgtcagagtcacaggtaatatccagcagcacagcgcgacgttccggcacttgatccagcccttccagcggcagaaccgggaacaactggtcgatcccccatgcgtccggcatcgactggaacagcgagaagttgacgtacattttgtccgccatacgttcctgcagctcgtcgataatcggacgatgagcacggttttgcggatccagctgcttttgcacttcatggcacatgctcaaataaagctgctcagcccatgcacgttcttgcaggctaaagatgccggaagagtagccgatatgaatgtcgtgcagatccatctgactgtcgtgtaaccattcacgcagagaacggcgagttcccggttcgtgcatctcctgccaggtttcccacatgctttgcagcgcgcgcggcgcatcttctgcaggcgcggtcggcaccgtgtattcgttacgttccacgccgatgatattagacaccagcacggtgtgatgcgcagtcaccgcacgacccgattcggtgattaccgtcggatgcggcagaccgttttcttcacacgcatcgccaatcgcccagataatgttgttggcgtattcattgaggccgtagttcaccgaacagtcggactgcgaacgagtaccttcataatccacgcccagaccgccgccgacgtcgaagcactgaatattgacgcccagcttgtgcagttccacatagaaacgcgcggattcacgaacgcctgtcgcgatatcgcgaatattcgccatctgcgaaccgaggtggaagtgcagtagttgcaggctgtcgagacgcccggcttcacgcagggtttcaaccagttgcagtacctgagtcgcagccaggccgaacttcgatttttccccgccggaggactgccatttacccgaaccctgcgaagccagacgtgcacgcacgcccagacgaggaacgacattcagacgttctgcttcatccagcacaatggcgatttctgacatcttctcaatgaccagatagaccttgtgccccatcttctcgccaattaatgccaggcggatatattcgcggtctttataaccgttgcagacgatgacgctacgggtcatgccagcatgtgccagtactgccatcaactcggctttggaaccggcttccagacccagcggttcgcccgaatgaatcagggactcaatcacgcggcggtgctggttaactttgatcggataaacaaggaagtaatcgccgttatagccgtaggattccctcgcacgtttgaacgcggcgttaatggaacgcaaacggtgctgcaggatctgtgggaaacagaacagtgcaggcagacgctggccctgtgcttcacgagttttcactaactgcgcgagatcgacgcgagcttccgggacgtccgggtccgggcacacgctaatgtggcccagctcgttaacgtcatagtagttattgccccaccaggcaatattgtaagtacgcagcatcttgctggcttcctgggagctcattgcaacctcctgcatggagcgtagtacaccgtgttcgcccgctgacgaaggcaaacccatagacatgtcgtcagacatagcgaacctcaaattattttattaagtgtaaaacagttaacgactatcgcagcctggaactgcgataacaacccataagcacatggattttccagcagtgaatgctgacgctccaactgcgcaaccggtttctttttcataacattattaagcacataaccgaacgtaagtgtgaaagttcggcgaaaccacgagaaaactcttgtttttacaagagcgcccttgttcagtcctcagtaactgtaaccagctcttgaatcctgagaagcgccgagatgggtataacatcggcaggtatgcaaagcagagatgcagagtgcggggaacgaatcttcaccagaacggtgagacaggttaagcagcagacaacggttcattatttcgtatcacctccacggccgcctgttaagacgaacccacaagccaaaactctgatttcaacccggctggaagtggcaacacgaaagaaacgtcgtgtgctttttatttaagccgcgcgccgcgttttataccccacaatggcagaaaattgcaaaagataaatacgcagaatgccggcattgtcaggaaaaatttccagccacgtttttaacagaatgagacacgattcaaaaaaaagtggaaatagggtgaagaattgacctaaaatagccatccagatgttaatccatccataccgattaacactcagactgccagtgtttttaacctgcagagtcgtggtaggatccgctaccacagaaaatccacacaacagtttgagctaaccaaattctctttaggtgatattaaatatggcaaaacacctttttacgtccgagtccgtctctgaagggcatcctgacaaaattgctgaccaaatttctgatgccgttttagacgcgatcctcgaacaggatccgaaagcacgcgttgcttgcgaaacctacgtaaaaaccggcatggttttagttggcggcgaaatcaccaccagcgcctgggtagacatcgaagagatcacccgtaacaccgttcgcgaaattggctatgtgcattccgacatgggctttgacgctaactcctgtgcggttctgagcgctatcggcaaacagtctcctgacatcaaccagggcgttgaccgtgccgatccgctggaacagggcgcgggtgaccagggtctgatgtttggctacgcaactaatgaaaccgacgtgctgatgccagcacctatcacctatgcacaccgtctggtacagcgtcaggctgaagtgcgtaaaaacggcactctgccgtggctgcgcccggacgcgaaaagccaggtgacttttcagtatgacgacggcaaaatcgttggtatcgatgctgtcgtgctttccactcagcactctgaagagatcgaccagaaatcgctgcaagaagcggtaatggaagagatcatcaagccaattctgcccgctgaatggctgacttctgccaccaaattcttcatcaacccgaccggtcgtttcgttatcggtggcccaatgggtgactgcggtctgactggtcgtaaaattatcgttgatacctacggcggcatggcgcgtcacggtggcggtgcattctctggtaaagatccatcaaaagtggaccgttccgcagcctacgcagcacgttatgtcgcgaaaaacatcgttgctgctggcctggccgatcgttgtgaaattcaggtttcctacgcaatcggcgtggctgaaccgacctccatcatggtagaaactttcggtactgagaaagtgccttctgaacaactgaccctgctggtacgtgagttcttcgacctgcgcccatacggtctgattcagatgctggatctgctgcacccgatctacaaagaaaccgcagcatacggtcactttggtcgtgaacatttcccgtgggaaaaaaccgacaaagcgcagctgctgcgcgatgctgccggtctgaagtaatctttcttcacctgcgttcaaaggccagcctcgcgctggcctttttcttttggataggcgttcacgccgcatccggcaaaaaaaccgcccgcacaataacatcattcttcctgatcacgtttcaccgcagattatcatcacaactgaaaccgattacaccaaccacaacagacaaagatttgtaatattttcatattattattcggttttcacagttgttacatttcttttcagtaaagtcttaattgcagataacagcgtttaatctatgatgatataactcaattattttcatgcacttaaatcataactaagataaatgttagtgtaagcgattacactgatgtgatttgcttcacatctttttacgtcgtactcacctatcttaattcacaataaaaaataaccatattggagggcatcatgcctgacgctaaaaaacaggggcggtcaaacaaggcaatgacgtttttcgtctgcttccttgccgctctggcgggattactctttggcctggatatcggtgtaattgctggcgcactgccgtttattgcagatgaattccagattacttcgcacacgcaagaatgggtcgtaagctccatgatgttcggtgcggcagtcggtgcggtgggcagcggctggctctcctttaaactcgggcgcaaaaagagcctgatgatcggcgcaattttgtttgttgccggttcgctgttctctgcggctgcgccaaacgttgaagtactgattctttcccgcgttctactggggctggcggtgggtgtggcctcttataccgcaccgctgtacctctctgaaattgcgccggaaaaaattcgtggcagtatgatctcgatgtatcagttgatgatcactatcgggatcctcggtgcttatctttctgataccgccttcagctacaccggtgcatggcgctggatgctgggtgtgattatcatcccggcaattttgctgctgattggtgtcttcttcctgccagacagcccacgttggtttgccgccaaacgccgttttgttgatgccgaacgcgtgctgctacgcctgcgtgacaccagcgcggaagcgaaacgcgaactggatgaaatccgtgaaagtttgcaggttaaacagagtggctgggcgctgtttaaagagaacagcaacttccgccgcgcggtgttccttggcgtactgttgcaggtaatgcagcaattcaccgggatgaacgtcatcatgtattacgcgccgaaaatcttcgaactggcgggttataccaacactaccgagcaaatgtgggggaccgtgattgtcggcctgaccaacgtacttgccacctttatcgcaatcggccttgttgaccgctggggacgtaaaccaacgctaacgctgggcttcctggtgatggctgctggcatgggcgtactcggtacaatgatgcatatcggtattcactctccgtcggcgcagtatttcgccatcgccatgctgctgatgtttattgtcggttttgccatgagtgccggtccgctgatttgggtactgtgctccgaaattcagccgctgaaaggccgcgattttggcatcacctgctccactgccaccaactggattgccaacatgatcgttggcgcaacgttcctgaccatgctcaacacgctgggtaacgccaacaccttctgggtgtatgcggctctgaacgtactgtttatcctgctgacattgtggctggtaccggaaaccaaacacgtttcgctggaacatattgaacgtaatctgatgaaaggtcgtaaactgcgcgaaataggcgctcacgattaatctccccaagcttcctcccatcgcggaggaagccacctcttgcagtcatcttttcttcgctctatcctctgccgctatgaaaacatcccgtctccctatcgccatccaacaggccgttatgcgtcgcctgcgggaaaaactcgcccaggccaacctgaagctagggcgtaactacccggagccaaaactctcttacacccagcgcggaacctccgccggaacggcctggctggaaagctatgaaattcgcctcaatcccgttttgctgttggaaaacagtgaagcttttattgaagaagtggtaccgcacgaactggcacatttgctggtatggaaacatttcggccgcgtagcgccacatggcaaagagtggaagtggatgatggaaaacgtgctgggtgttcccgcccgtcgtacgcatcagttcgaactgcaatccgtgcgtcgcaacaccttcccctaccgctgcaagtgccaggagcatcagcttaccgtacgccgccataatcgcgtagttcgtggcgaggccgtctatcgctgtgttcactgcggtgaacagctggttgcgaaataaccatctgaactatcaggaactttcctgatctggctgattgcataccaaaacagctttcgctacgttgctggctcgttttaacacggagtaagtgatgtaccgttatttgtctattgctgcggtggtactgagcgcagcattttccggcccggcgttggccgaaggtatcaatagtttttctcaggcgaaagccgcggcggtaaaagtccacgctgacgcgcccggtacgttttattgcggatgtaaaattaactggcagggcaaaaaaggcgttgttgatctgcaatcgtgcggctatcaggtgcgcaaaaatgaaaaccgcgccagccgcgtagagtgggaacatgtcgttcccgcctggcagttcggtcaccagcgccagtgctggcaggacggtggacgtaaaaactgcgctaaagatccggtctatcgcaagatggaaagcgatatgcataacctgcagccgtcagtcggtgaggtgaatggcgatcgcggcaactttatgtacagccagtggaatggcggtgaaggccagtacggtcaatgcgccatgaaggtcgatttcaaagaaaaagctgccgaaccaccagcgcgtgcacgcggtgccattgcgcgcacctacttctatatgcgcgaccaatacaacctgacactctctcgccagcaaacgcagctgttcaacgcatggaacaagatgtatccggttaccgactgggagtgcgagcgcgatgaacgcatcgcgaaggtgcagggcaatcataacccgtatgtgcaacgcgcttgccaggcgcgaaagagctaacctacactagcgggattctttttgttaacccctaccccacgcgtacaaccgcgtggggagacgacgcggatttttaactatgcgtatcccccgcatttatcatcctgaaccactgaccagccattctcacatcgcgctttgcgaagatgccgccaaccatatcgggcgcgtactgcgcatggggccggggcaggcgttgcaattgtttgacggtagcaaccaggtctttgacgccgaaattaccagcgccagcaaaaaaagcgtggaagtgaaggtgctggaaggccagatcgacgatcgcgaatctccgctgcatattcacctcggtcaggtgatgtcgcgtggtgaaaaaatggaatttactatccagaaatcgatcgaactcggtgtaagcctcattacgccacttttttctgagcgctgcggcgttaaactggatagtgaacgtctgaacaagaagcttcagcagtggcagaagattgcaattgctgcctgtgagcagtgtggtcgtaaccgggtgccggaaatccgtccagcgatggatctggaagcctggtgtgcagagcaggatgaaggactgaaactgaatcttcacccgcgcgccagtaacagcatcaatacgttgccgttaccggttgaacgcgtccgcctgctgattggcccggaaggcggtttatcggcagatgaaattgccatgactgcccgctatcaatttactgatatcctgttgggacctcgcgttttgcgtacagagacaactgcgctcaccgccattaccgcgctacaagtacgatttggcgatttgggctaacggagaagaataatgatcaagctcggcatcgtgatggaccccatcgcaaacatcaacatcaagaaagattccagttttgctatgttgctggaagcacagcgtcgtggttacgaacttcactatatggagatgggcgatctgtatctgatcaatggtgaagcccgcgcccatacccgcacgctgaacgtgaagcagaactacgaagagtggttttcgttcgtcggtgaacaggatctgccgctggccgatctcgatgtgatcctgatgcgtaaagacccgccgtttgataccgagtttatctacgcgacctatattctggaacgtgccgaagagaaagggacgctgatcgttaacaagccgcagagcctgcgcgactgtaacgagaaactgtttaccgcctggttctctgacttaacgccagaaacgctggttacgcgcaataaagcgcagctaaaagcgttctgggagaaacacagcgacatcattcttaagccgctggacggtatgggcggcgcgtcgattttccgcgtgaaagaaggcgatccaaacctcggcgtgattgccgaaaccctgactgagcatggcactcgctactgcatggcgcaaaattacctgccagccattaaagatggcgacaaacgcgtgctggtggtggatggcgagccggtaccgtactgcctggcgcgtattccgcaggggggcgaaacccgtggcaatctggctgccggtggtcgcggtgaacctcgtccgctgacggaaagtgactggaaaatcgcccgtcagatcgggccgacgctgaaagaaaaagggctgatttttgttggtctggatatcatcggcgaccgtctgactgaaattaacgtcaccagcccaacctgtattcgtgagattgaagcagagtttccggtgtcgatcaccggaatgttaatggatgccatcgaagcacgtttacagcagcagtaacccaccttagcgagaaggatctcgttgagactctgagtgacagcgcccttctttccacgcatactgggcgctgttgcttttttgaaccaggaaacagaacctctgacaatgaatttacagcatcactttcttattgccatgcctgctctccaggatccgattttccgtcgttccgtggtctacatttgcgaacataataccaatggtgcaatggggatcatcgtcaacaagccgctggaaaatctcaaaattgaagggattctggaaaagctgaagatcacgccggagccgcgtgatgaatcaatccgtctggataaaccggttatgctcggcggtccgctggctgaagatcgcgggtttattttgcatactccgccctccaattttgcttccagcattcgcatttcagacaacacggtaatgaccacttcccgcgatgtgctggaaacgctcggcaccgataaacaaccgtctgacgtattggtggctctgggttatgcctcctgggagaaaggtcaactggaacaagaaattctcgataacgcgtggctaacggccccggcagatctgaatattctgttcaaaacgccgattgccgaccgctggcgcgaggcggcaaaactgattggtgtggatattctcaccatgcctggtgtggcaggacacgcctgatgagtggaaccttactcgccttcgacttcggcaccaaaagcattggcgtagcggtcggccaacgcattaccggcaccgctcgccctttgcctgcaattaaagcacaggacggtacgccggactggaacattatcgagcgtttactgaaagagtggcagccggacgaaatcatcgtcggtttgccgctgaatatggacggcaccgagcaaccattgactgccagagcgcgtaaatttgccaaccgtattcatggccgtttcggtgttgaagtaaagctccatgacgagcgtcttagcactgtggaagcccgttccggtctgtttgaacagggcggctatcgggcgctcaacaaaggcaaagttgactctgcctctgcggttattattctcgaaagctatttcgagcagggatattaaggcgatttaaacgcctggcggagtgtaaataatatcatcgcgtcttattgccggatgcggcgtgaacaccttatccagcacacatctggcagcggctataggtctgataagacgcgttagcgtcgcatcagacatttattgcctttgtaggcccgataagcttgcgcatcgggcatggcaacgtcacaaacgcccttcccccacccggtgctgataactctgctgaaacgttatcatccccacctgctgcccggtttgaataacatgcggtaactggtgggttttcccttcgcgaatcaaattccccaccgcgggtgtgttaatcagcaattcaaatagcgccacgcgtccttcctgtttatccacttccagcttttgtgacagcactgcccgtaaactacctgccagttgattacgcacggggtctttttcctgcgccggaaatgaatccaccagtcgctcaactgcctgcgcggcaccacgcgtatgtaatgttgccagcaccaaatgcccggtttctgccgccgtcagtgccagacggattgtctcgctgtcacgcagctctccgagcaaaatcacatcaggatcttcccgcaatgcggcccgcaatcccgatgcgaacgtcatacagtgcaaaccaatttcccgctgctggatcaaacatcgctggctggcatagagatattcaacaggatcttccagcgtcagaatatgcgcatcggcatgttgattgagatagccaaccatcgccgccagcgtggtagatttgccactccccgtcgcccccgtcaccagaatcaggccattctcgctcttgagtaattccggcaataccgttggtgcgccaagctgttcgagctgcgggcagtgcgaaggtaacagccgtaacgccagcgaaatgccatgccgttgcgcgaatgcgctgccacgcaatcgctggttttccgccagcgacacggcaaaatccagctgaccattctccagcaatattgcccgctgatcgtcatccagccactcccgcagtagctcttcgacgtccggcgtatcaaacggcgcagcttccattctgccgcgaatgcgccatcgtgcgggccaggcgctgcacaggtgtagatccgagacgttatgctttacactaagggccacaatttcttccatattcatactaagatcctcggaa
